(12) United States Patent
Wenzel et al.

(10) Patent No.: US 9,127,298 B2
(45) Date of Patent: Sep. 8, 2015

(54) PRODUCTION OF FATTY ACIDS BY HETEROLOGOUS EXPRESSION OF GENE CLUSTERS FROM MYXOBACTERIA

(75) Inventors: Silke Wenzel, Saarbruecken (DE);
Shwan Rachid, Saarbruecken (DE);
Katja Gemperlein, Mandelbachtal (DE); Rolf Mueller, Blieskastel (DE)

(73) Assignee: Universitaet des Saarlandes, Saarbruecken (DE)

( * ) Notice: Subject to any disclaimer, the term of this patent is extended or adjusted under 35 U.S.C. 154(b) by 0 days.

(21) Appl. No.: 13/701,411

(22) PCT Filed: May 30, 2011

(86) PCT No.: PCT/EP2011/058863
§ 371 (c)(1),
(2), (4) Date: Mar. 11, 2013

(87) PCT Pub. No.: WO2011/151298
PCT Pub. Date: Dec. 8, 2011

(65) Prior Publication Data
US 2013/0196391 A1 Aug. 1, 2013

(30) Foreign Application Priority Data
May 31, 2010 (EP) .................... 10005644

(51) Int. Cl.
C12P 7/64 (2006.01)
C12N 9/02 (2006.01)
C12N 9/10 (2006.01)
C12N 15/52 (2006.01)

(52) U.S. Cl.
CPC ............... *C12P 7/6427* (2013.01); *C12N 9/001* (2013.01); *C12N 9/1029* (2013.01); *C12N 15/52* (2013.01); *C12P 7/64* (2013.01)

(58) Field of Classification Search
None
See application file for complete search history.

(56) References Cited

U.S. PATENT DOCUMENTS

2011/0275846 A1   11/2011   Roemer et al.

OTHER PUBLICATIONS

Yamashita et al., Topology of Acyltransferase Motifs and Substrate Specificity and Accessibility in 1-acyl-*sn*-glycero-3-phosphate Acyltransferase I, *Biochim. Biophys. Acta* 1771:1202-1215 (2007).
Application AGPAT Sequences Alignment: Amino Acid Sequence Alignment of Myxobacterial Acyl Glycerolphosphate Acyl Transferases (SEQ ID No. 30; SEQ ID No. 31; SEQ ID No. 95; SEQ ID No. 129; SEQ ID No. 135; and SEQ ID No. 169).
Domain IV Percent Identity Matrix.
Alignment AGPAT Motifs: Amino Acid Sequence Alignment of Myxobacterial Acyl Glycerolphosphate Acyl Transferases (AGPAT), *Escherichia coli* AGPAT (PlsC), and Human AGPAT1.

(Continued)

*Primary Examiner* — Nashaat Nashed
(74) *Attorney, Agent, or Firm* — Seed IP Law Group PLLC

(57) ABSTRACT

The invention relates to a process for producing one or more polyunsaturated fatty acids by means of heterologous gene expression comprising the steps of providing a production organism which comprises a heterologous gene cluster encoding a polyunsaturated fatty acid biosynthetic pathway encompassing a subsequence ER encoding an enoylreductase and a subsequence AT encoding an acyltransferase, growing the production organism in the presence of a fermentable carbon source whereby one or more polyunsaturated fatty acids are produced, and optionally recovering the one or more polyunsaturated fatty acids.

15 Claims, 9 Drawing Sheets

(56) References Cited

OTHER PUBLICATIONS

Allen et al., "Structure and Regulation of the Omega-3 Polyunsaturated Fatty Acid Synthase Genes from the Deep-Sea Bacterium *Photobacterium profundum* Strain SS9," *Microbiology* 148:1903-1913, 2002.

Bankar et al., "Environmental and Industrial Applications of *Yarrowia lipolytica*," *Appl. Microbiol. Biotechnol.* 84:847-865, 2009.

Dickschat et al., "Biosynthesis of Iso-Fatty Acids in Myxobacteria," *Org. Biomol. Chem.* 3:2824-2831, 2005.

Domergue et al., "New Insight into *Phaeodactylum tricornutum* Fatty Acid Metabolism. Cloning and Functional Characterization of Plastidial and Microsomal Δ12-Fatty Acid Desaturases," *Plant Physiology* 131(4):1648-1660.

Gentile et al., "*Shewanella* sp. *GA-22*, a Psychrophilic Hydrocarbonoclastic Antarctic Bacterium Producing Polyunsaturated Fatty Acids," *Journal of Applied Microbiology* 95:1124-1133, 2003.

Graham et al., "Rational Metabolic Engineering of Transgenic Plants for Biosynthesis of Omega-3 Polyunsaturates," *Current Opinion in Biotechnology* 18:142-147, 2007.

Gross et al., "Metabolic Engineering of *Pseudomonas putida* for Methylmalonyl-CoA Biosynthesis to Enable Complex Heterologous Secondary Metabolite Formation," *Chemistry and Biology* 13:1253-1264, 2006.

Idiris et al., "Engineering of Protein Secretion in Yeast: Strategies and Impact on Protein Production," *Appl. Microbiol. Biotechnol.* 86:403-417, 2010.

Jiang et al., "Tandem Acyl Carrier Protein Domains in Polyunsaturated Fatty Acid Synthases," *Methods in Enzymology* 459:79-96, 2009.

Lee et al., "Eicosapentaenoic Acid (EPA) Biosynthetic Gene Cluster of *Shewanella oneidensis* MR-1: Cloning, Heterologous Expression, and Effects of Temperature and Glucose on the Production of EPA in *Escherichia coli*," *Biotechnology and Bioprocess Engineering* 11:510-515, 2006.

Lee et al., "Enhancement of Heterologous Production of Eicosapentaenoic Acid in *Escherichia coli* by Substitution of Promoter Sequences Within the Biosynthesis Gene Cluster," *Biotechnol Lett.* 30:2139-2142, 2008.

Lee et al., "Isolation and Characterization of the Eicosapentaenoic Acid Biosynthesis Gene Cluster form *Shewanella* sp. BR-2," *J. Microbiol. Biotechnol.* 19(9):881-887, 2009.

Li et al., "Improvement of Arachidonic Acid and Eicosapentaenoic Acid Production by Increasing the Copy Number of the Genes Encoding Fatty Acid Desaturase and Elongase into *Pichia pastoris*," *Biotechnol. Lett.* 31:1011-1017, 2009.

Metz et al., "Production of Polyunsaturated Fatty Acids by Polyketide Synthases in Both Prokaryotes and Eukaryotes," *Science* 293(5528):290-293, 2001.

Morita et al., "Biosynthesis of Fatty Acids in the Docosahexaenoic Acid-Producing Bacterium *Moritella marina* Strain MP-1," *Biochemical Society* 28(6):943-945, 2000.

Morita et al., "Cloning and Sequencing of Clustered Genes Involved in Fatty Acid Biosynthesis from the Docosahexaenoic Acid-Producing Bacterium, *Vibrio marinus* Strain MP-1," *Biotechnology Letters* 21:641-646, 1999.

Nichols et al., "Developments with Antarctic Microorganisms: Culture Collections, Bioactivity Screening, Taxonomy, PUFA Production and Cold-Adapted Enzymes," *Curr. Opin. Biotechnol.* 10(3):240-246, 1999.

Orikasa et al., "Enhanced Heterologous Production of Eicosapentaenoic Acid in *Escherichia coli* Cells that Co-Express Eicosapentaenoic Acid Biosynthesis *pfa* Genes and Foreign DNA Fragments Including a High-Performance Catalase Gene, *vktA*," *Biotechnol. Lett* 29:803-809, 2007.

Orikasa et al., "Recombinant Production of Docosahexaenoic Acid in a Polyketide Biosynthesis Mode in *Escherichia coli*," *Biotechnol. Lett.* 28:1841-1847, 2006.

Porro et al., "Recombinant Protein Production in Yeasts," *Molecular Biotechnology* 31(3):245-259, 2005.

Schneiker et al., "Complete Genome Sequence of the Myxobacterium *Sorangium cellulosum*," *Nature Biotechnology* 25(11):1281-1289, Nov. 2007.

Silva et al., "Application of Methylotrophic Yeast *Pichia pastoris* in the Field of Food Industry—A Review," *Journal of Food, Agriculture & Environment* 7(2):268-273, 2009.

Taylor et al., "Molecular Cloning and Characterization of a *KCS* Gene from *Cardamine graeca* and its Heterologous Expression in *Brassica* Oilseeds to Engineer High Nervonic Acid Oils for Potential Medical and Industrial Use," *Plant Biotechnology Journal* 7:925-938, 2009.

Takeyama et al., "Expression of the Eicosapentaenoic Acid Synthesis Gene Cluster from *Shewanella* sp. In a Transgenic Marine Cyanobacterium, *Synechococcus* sp.," *Microbiology* 143:2725-2731, 1997.

Tanaka et al., "Isolation of Clustered Genes that are Notably Homologous to the Eicosapentaenoic Acid Biosynthesis Gene Cluster from the Docosahexaenoic Acid-Producing Bacterium *Vibrio marinus* Strain MP-1," *Biotechnology Letters* 21:939-945, 1999.

Wenzel et al., "The Biosynthetic Potential of Myxobacteria and their Impact on Drug Discovery," *Current Opinion in Drug Discovery & Development* 12(2):220-230, 2009.

Wenzel et al., "Heterologous Expression of a Myxobacterial Natural Products Assembly Line in Pseudomonads via Red/ET Recombineering," *Chemistry & Biology* 12:349-356, Mar. 2005.

Wenzel et al., "The Impact of Genomics on the Exploitation of the Myxobacterial Secondary Metabolome," *National Product Reports* 26:1385-1407, 2009.

Wenzel et al., "Recent Developments Towards the Heterologous Expression of Complex Bacterial Natural Product Biosynthetic Pathways," *Current Opinion in Biotechnology* 16:594-606, 2005.

A)

B)

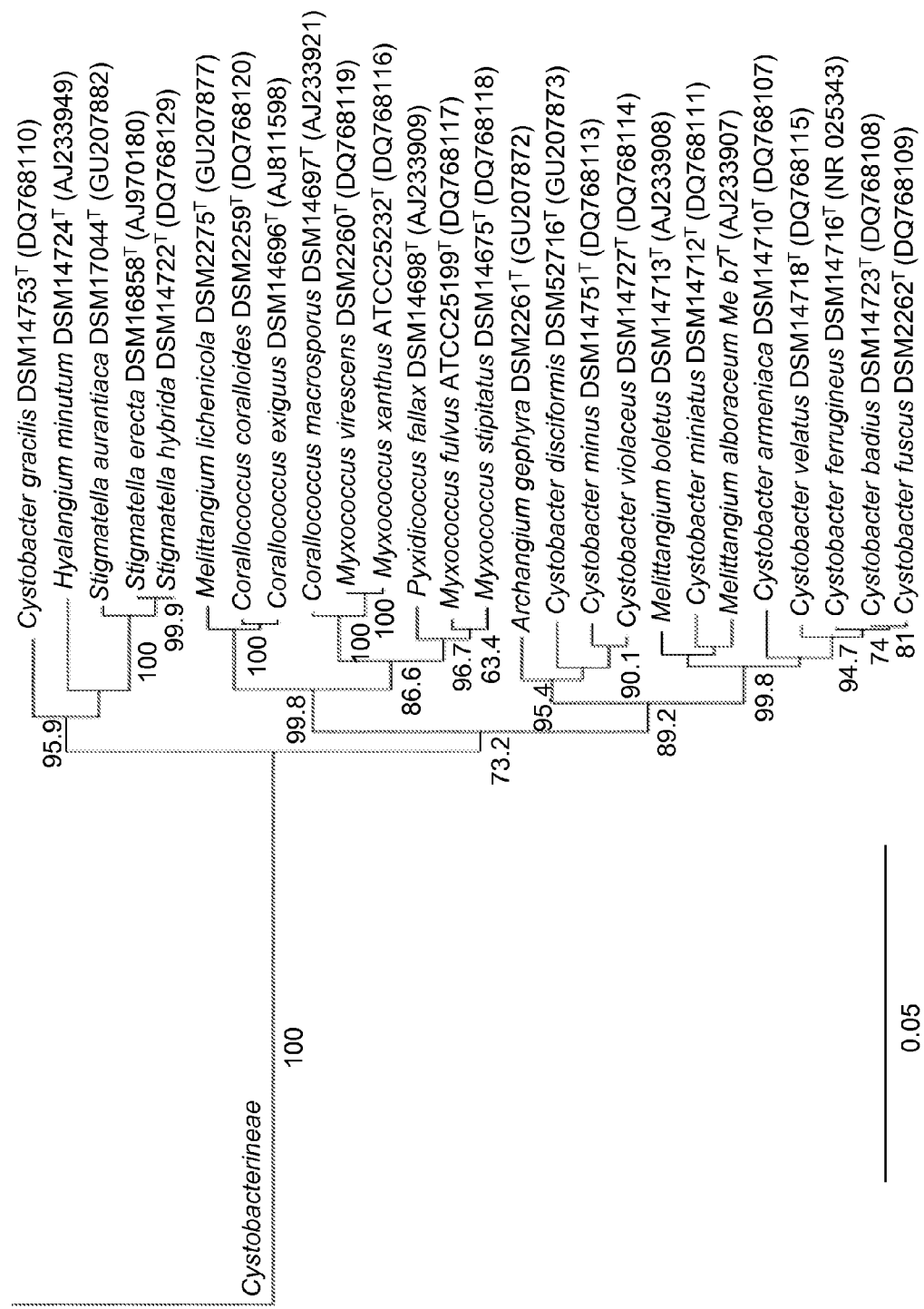
Cont. of Figure 6

Cont. of Figure 7
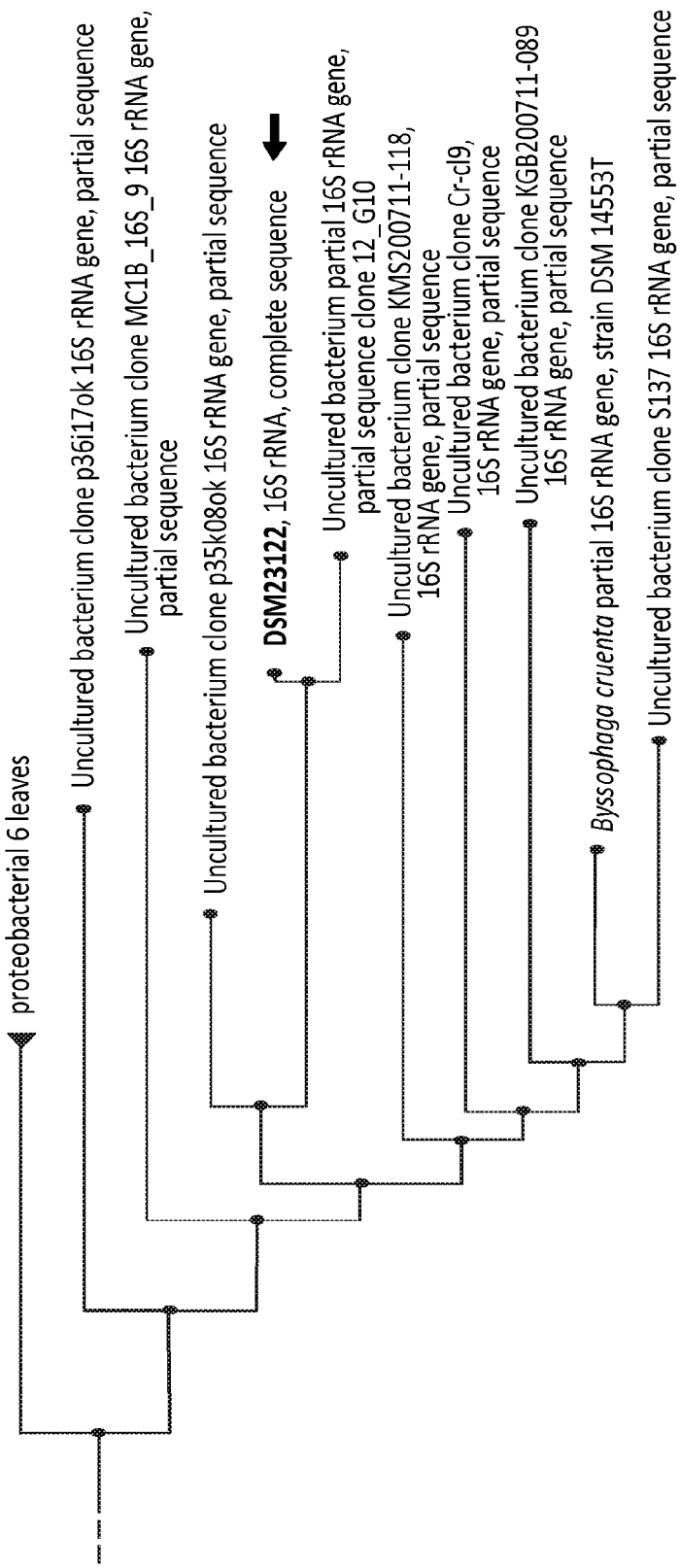

PRODUCTION OF FATTY ACIDS BY HETEROLOGOUS EXPRESSION OF GENE CLUSTERS FROM MYXOBACTERIA

CROSS REFERENCE TO RELATED APPLICATIONS

This application is a U.S. national stage application filed under 35 U.S.C. §371 of International Patent Application No. PCT/EP2011/058863 accorded an international filing date of May 30, 2011, which application claims priority from European Patent Application No. 10005644.9 filed on May 31, 2010; which applications are incorporated herein by reference in their entirety.

STATEMENT REGARDING SEQUENCE LISTING

The Sequence Listing associated with this application is provided in text format in lieu of a paper copy, and is hereby incorporated by reference into the specification. The name of the text file containing the Sequence Listing 920130_401USPC_SEQUENCE_LISTING.txt. The text file is about 1.3 MB, was created on Mar. 11, 2013, and is being submitted electronically via EFS-Web.

The invention provides a method for producing long-chain polyunsaturated fatty acids (PUFAs), preferably omega-3 polyunsaturated fatty acids, by heterologous expression of gene clusters encoding a PUFA biosynthetic pathway, originating from specific myxobacterial strains. These unique gene clusters can be cloned and incorporated into a wide range of suitable organisms for production in enhanced amounts of PUFAs, particularly omega-3 PUFAs, by heterologous expression.

TECHNICAL BACKGROUND OF THE INVENTION

Long-chain polyunsaturated fatty acids, including those of the omega-3 family which are also known as ω-3 ("omega-3") PUFAs are interesting fatty acids in nature. They are important constituents of phospholipids that play a role in decreasing membrane rigidity. Eicosapentaenoic acid (EPA) is a major constituent of the human brain's phospholipids and serves as precursor of prostaglandins and resolvins. Another important PUFA of the omega-3 family is docosa hexaenoic acid (DHA). Improved cognitive and behavioural function in infant development seems correlated to high levels of this compound. For omega-3 PUFAs, and in particular for DHA and EPA, beneficial health effects have been shown e.g. the prevention of cancer, rheumatoid arthritis, cardiovascular diseases, the improvement of immune function, and eye and brain health (Teale, M C (ed.) 2006, "Omega-3 fatty acid research", Nova Science Publishers. New York, and references therein). Because of these beneficial properties omega-3 PUFAs are being used extensively as nutritional lipids in health and dietary supplements and as functional ingredients in a wide range of foods. Omega-3 PUFAs presently comprise one of the biggest and strongest growing market segments in the food and beverage industry sector, with substantially increasing demand over the past years. These days, fish oil is the most abundant and widely used natural source for omega-3 fatty acids, but named source suffers from over fishing, lack in high grade oil supply with sufficient content of DHA/EPA, and quality issues (smell, formulation challenges etc.). Alternative processes involving algae and oomycetes as producer organisms are established or under development (Hinzpeter, Grasas y Aceites (2006) 57:336-342; Ward, Process Biochemistry (2005) 40:3627-3652). Since the supply of fish oil of high quality is increasingly limited, it was attempted to find alternative, sustainable biological sources.

Various groups of marine algae have been explored for over 20 years and some products based on algal biomass have meanwhile entered the market. Some oomycetes belonging to the group of stramenopiles (a group of algae-like eukaryotic organisms also known as "Chromophyta") were also occasionally reported to produce the above mentioned compounds (e.g. of the genera *Achyla* and *Pythium*; (Aki, J. Ferm. Bioeng. (1998) 86:504-507; Cheng, Biores. Technol. (1999) 67:101-110; Athalye, J. Agric. Food Chem. (2009) 57:2739-2744). In other stramenopiles (e.g. the genera *Schizochytrium* and *Thraustochytrium*; as described in U.S. Pat. No. 7,022,512 and WO2007/068997) and in species of the dinoflagellate *Amphidinium* (US 2006/0099694), DHA may represent up to 48% of the fatty acid content of the cells, which are the highest contents so far known in the Eukaryota. However, the cultivation of these organisms in industrial scale still poses a challenge even after several years of development. Other alternative biological sources for omega-3 PUFAs hitherto found are prokaryotic eubacteria [Nichols, Curr. Opin. Biotechnol. (1999) 10:240-246; Gentile, J. Appl. Microbiol. (2003) 95:1124-1133]. However, the commercial exploitation of these organisms for PUFA production on an industrial scale is hampered by the slow growth characteristics of these psychrophilic microorganisms, as well as their inherently low yields and productivity. Heterologous expression of Omega-3 PUFA gene clusters in suitable, industrial organisms constitutes a valid alternative to the production of the desired Omega-3-PUFAs at an industrial scale, which has manifold advantages to production processes using the wild type strains. It has been established for a long time that Omega-3-PUFAS are biosynthesized in a similar manner as the polyketide secondary metabolites in both prokaryotic and eukaryotic organisms (see overview by Metz, Science (2001) 293:290-293), which allows for utilization of similar methods techniques as those that have been established in microbial biotechnology in order to improve and modify production of antibiotics and anticancer agents. For myxobacteria, such work regarding evaluation of secondary metabolites biosyntheses has been described and outlined in recent reviews. (Wenzel, Curr. Opin. Biotechnol. (2005), 16: 594-606; Wenzel, Curr. Opin. Drug Discov. & Develop. (2009), 12 (2): 220-230; Wenzel, Nat. Prod. Rep. (2009), 26 (11): 1385-1407).

The organization of the PUFA genes in gene clusters allows for their cloning and transfer into heterologous hosts, which can per se be either prokaryotic or eukaryotic organisms.

Gene clusters encoding synthetic pathway enzymes for biosynthesis of omega-3 PUFAs are known from various marine bacteria, including species of the genera *Moritella* (Tanaka, Biotechnol. Lett. (1999) 21:641-646; Morita, Biochem Soc Trans 28:943-945 (2000)), *Photobacterium* (Allen, Microbiology (2002) 148:1903-1913), and *Shewanella* (Lee, J. Microbiol. Biotechnol. (2009) 19:881-887). Such bacterial omega-3 PUFA biosynthetic gene clusters were already transferred to and expressed in *Escherichia coli* (Lee, Biotechnol. Bioproc. Engin. (2006) 11:510-515; Orikasa, Biotechnol. Lett. (2006) 28:1841-1847; Orikasa, Biotechnol. Lett. (2007) 29:803-812). Furthermore, heterologous EPA production was enhanced by substitution of promoter sequences within the biosynthesis gene cluster (Lee, Biotechnol. Lett. (2008) 30:2139-2142). The EPA gene cluster from a *Shewanella* sp. was also expressed in the transgenic marine cyanobacterium of the genus *Synechococcus* (Takeyama, Microbiology (1997) 143 (Pt 8):2725-2731. Orikasa, Biotechnol. Lett. (2007) 29, 803-809) observed enhanced heterologous production of EPA in *E. coli* cells that co-express EPA biosynthesis genes and foreign DNA fragments including a high-performance catalase gene. The yields of EPA were augmented from 3% to 12% of the total fatty acid content. Jiang (Methods in Enzymology (2009) 459, 80-96) have summarized previous research on the characterization of the important tandem acyl carrier protein domains in polyunsaturated fatty acid synthases, also accounting for several other studies that involved heterologous expression of the respective genes in *E. coli*. These examples show that it is feasible to attain heterologous production of bacterial Omega-3 PUFA genes, even though no commercial product based on such techniques has so far resulted. Myxobacterial Omega-3 PUFA gene clusters were so far never identified and thus not expressed heterologously. Myxobacterial natural product biosynthetic pathways have been successfully expressed in a variety of heterologous hosts including *Pseudomonas putida* (Gross, Chem. Biol., (2006) 13: 1253-1264; Wenzel, Chem. Biol. (2005) 12 (3): 349-356).

Due to the great commercial significance of these products, there are various examples for the feasibility of heterologous expression of genes involved in biosynthesis of omega-3 PUFAs from various eukaryotic and prokaryotic organisms in transgenic plants and fungi. As exemplified by Domergue (Plant Physiol. (2003) 131, 1648-1660) and the fatty acid biosynthetic genes of the stramenopile alga, *Phaeodactylum tricornutum*, even the elucidation of the biosynthesis of certain marine biological sources that are not easy to cultivate in the laboratory have often involved their heterologous expression in *Saccharomyces cerevisiae* or other yeasts. Cipak (Free Radic. Biol. & Med. (2006) 40, 897-906) expressed a desaturase gene from the rubber tree *Hevea brasiliensis* also in *S. cerevisiae*. Tonon (2005, Plant Physiol. 138, 402-408) used the same host to express and characterize a acyl-coenzyme A (acyl-CoA) synthetase that was found from genome mining in the diatom, *Thalassiosira pseudonana*. Hsiao (2007, Mar. Biotechnol. 9, 154-165) also used *S. cerevisiae* as host for heterologous expression and functional characterization of a delta-6 desaturase from the marine microalga *Glossomastix chrysoplasta*. Lee (2008, Biotechnol. Bioproc. Engin., 13, 524-532) have demonstrated successfully the activity of delta-9 elongase, a crucial enzyme in Omega-3 PUFA biosynthesis from the stramenopile, *Thraustochytrium aureum* by heterologous expression in the yeast *Pichia pastoris*. Li (Biotechnol. Lett., 31, 1011-1017) reported an improvement of arachidonic acid and eicosapentaenoic acid production by increasing the copy number of the genes encoding fatty acid desaturase and elongase from the alga *Phaeodactylum tricornutum* in *Pichia pastoris* as heterologous host; however, only relatively low percentages of the PUFAs of 0.1 and 0.1%, respectively of the total fatty acid content of *Pichia pastoris* were attained. The latter yeast, as well as *Yarrowia lipolytica, Hansenula anomala*, and other methylotrophic and/or oleaginous yeasts, appear ideal for production of PUFAs as they are well-established industrial producer organisms (Banlar, Appl. Microbiol. Biotechnol. (2009) 84, 47-865; Silva, J. Food, Agric. & Environment. 2009, 7, 268.273). Moreover, oleaginous yeasts, which are especially preferred production organisms and which are capable of growing in highly lipophilic environments may accumulate very large amounts of lipids, and can use a broad range of hydrocarbons as substrates. Other applications of yeast-like fungi in industrial microbiology and biotechnology have been summarized by Porro (2005, Mol. Biotechnol. 31, 245-259) and Idiris (2010, Appl. Microbiol. Biotechnol. 86:403-417).

Graham (Curr. Opin. Biotechnol. (2007) 18 (2), 142-147) have summarized the state of the art in metabolic engineering of transgenic plants for biosynthesis of omega-3 PUFAs. They emphasized in particular the recent progress in the rational design of oilseed crops with high content of Omega-3 PUFAS but also discussed several factors that may be responsible for the hitherto observed, inherent low yields, which so far prevented the development of competitive production processes for PUFAs by using oilseed or other seed plants. Taylor (Plant Biotechnol. J. (2009) 7, 925-938) have recently identified and cloned 3-ketoacyl-CoA synthase from *Cardamine graeca* and reported its heterologous expression in *Brassica* oilseeds, resulting in increased production rates of the PUFA, nervonic acid and reported a 15 fold increase of nervonic acid in the heterologous host. However, nervonic acid is an omega-9, rather than an omega-3 PUFA and has by far not reached the commercial importance of DHA and EPA. In addition, nervonic acid is derived from elongation of oleic acid in nature.

Lee et al (Biotech. Bioproc. Eng. (2006) 11, 510-515) describe the heterologous expression of a putative polyketide synthetase gene cluster from *Shewanella oneidensis* MR-1 for production of EPA in *E. coli*. The gene cluster is identified only as a 20.195 kb DNA fragment obtained by long PCR using a primer pair, the nucleotide sequences of which are given, and by the sizes of restriction fragment generated by BglII and NdeI.

Orikasa et al (Biotechnol. Lett. (2006) 28, 1841-1847) describe synthesis of DHA in *E. coli* by expression of a gene cluster from *Moritella marina* MP-1.

Schneiker et al (nature biotechnology (2007) 25, 1281-1289) describe sequencing the complete genome of *Sorangium cellulosum* and identify polyketide synthetase gene clusters involved in synthesis of single antibiotic compounds. A comparison to the *Myxococcus xanthus* genome revealed a lack of global synteny.

Dickschat et al (Org. Biomol. Chem. (2005) 3, 2824-2831) describes the analysis of the fatty acid profile of *Stigmatella aurantiaca* using GC-MS, and the synthetic steps of biosynthesis.

There is a demand for methods for the production of PUFAs, particularly PUFAs containing 3, 4 or more double bonds, which methods biosynthesize the PUFAs de novo, rather than modify, e.g. elongate, other fatty acids which in turn serve as precursors.

OBJECT OF THE INVENTION

It is an object of the invention to provide a method for the production of PUFAs which has advantages compared to the methods of the prior art, preferably a production process using fermentation of a host microorganism expressing the relevant synthetic pathway enzymes.

GENERAL DESCRIPTION OF THE INVENTION

The invention achieves the object by the production process as defined in the claims, especially by providing the DNA sequences encoding the synthetic pathway enzymes for synthesis of PUFAs, a microorganism which is genetically manipulated to contain these DNA sequences for heterologous expression, and a process for producing one or more polyunsaturated fatty acids by cultivation of the microorganism which is genetically manipulated to contain DNA sequences encoding the synthetic pathway enzymes for synthesis of PUFAs for heterologous gene expression, the process preferably comprising the steps of
(i) providing a production organism which comprises a gene cluster encoding a polyunsaturated fatty acid biosynthetic pathway, said gene cluster being derived from a source organism which differs from the production organism; and encompassing a subsequence ER encoding an enoylreductase and a subsequence AT encoding an acyltransferase, wherein the subsequence AT is located downstream with respect to the subsequence ER;
(ii) growing the production organism of step (i) in the presence of a fermentable carbon source, also termed cultivating, whereby one or more polyunsaturated fatty acids are produced; and
(iii) optionally, recovering the one or more polyunsaturated fatty acids, preferably isolating polyunsaturated fatty acids from the fermentation broth and/or from the production organism.

The inventors have surprisingly found that myxobacterial PUFA biosynthetic gene clusters, e.g. derived from *Sorangium cellulosum* and from *Aetherobacter fasciculatus*, each encompassing the genes pfa1, pfa2 and pfa3 and thus, encoding the corresponding proteins Pfa1, Pfa2, and Pfa3, can be advantageously utilized in the production of PUFAs. Analysis of the biosynthetic loci shows that the arrangement of the genes as well as the organization of the catalytic domains in the biosynthetic proteins differ significantly from the published sequences of PUFA gene clusters from various other organisms. For the purposes of the invention, the terms amino acid sequence, peptide, protein, and a section of one of these can be used interchangeably. Reference to the function of an amino acid sequence encoded by a nucleic acid sequence can include the reference to the coding nucleic acid sequence, and further, reference to the catalytic function of a domain can be taken as a reference to the nucleic acid sequence section encoding the peptide section having the catalytic function, which nucleic acid sequence section can also be termed nucleic acid domain. Sequences and sections thereof which are referred to as a domain can include one or more catalytic centers or catalytic domains, which are e.g., designated according to their catalytic function. Sequence identities and similarities are preferably as determined by the ClustalW or GENEIOUS algorithm as described herein. Due to the universality of the genetic code, a nucleic acid sequence encoding a domain is determined by the amino acid sequence of the domain, wherein preferably the nucleic acid sequence has a codon usage or codon bias of the host microorganism that is genetically manipulated to contain the heterologous genes encoding the PUFA synthetic enzyme gene cluster, e.g., a nucleic acid sequence encoding the gene cluster and having the codon usage of the host microorganism.

Generally preferred, gene pfa 1 contains a domain I comprising a nucleotide sequence encoding an enoylreductase (ER), gene pfa2 contains a domain IIa comprising a nucleotide sequence encoding a ketosynthase domain (KS) and encoding a malonyl-CoA-transacylase domain (MAT), a domain IIb comprising a nucleotide sequence encoding at least one, preferably three, four or five acylcarrier protein domains (ACP), and a domain IIc comprising a nucleotide sequence encoding a ketoreductase domain (KR) and encoding a dehydratase domain (DH), and gene pfa3 contains a domain IIIa comprising a nucleotide sequence encoding a ketosynthase domain (KS) and encoding a chain length factor domain (CLF), a domain IIIb comprising a nucleotide sequence encoding one, preferably two dehydratase domains (DH), and contains a domain IV* comprising a nucleotide sequence encoding an acyl glycerolphosphate acyl transferase (AGPAT), wherein preferably the domains are arranged from 5' to 3' in the respective genes. In the synthetic gene cluster of *Aetherobacter*, between region IIIa and region IIIb, a domain IV has been found encoding an acyl transferase. Accordingly, an optional domain IV comprising a nucleotide sequence encoding an acyltransferase domain (AT) is arranged in gene pfa3 between domain IIIa and domain IIIb, especially for the production of EPA and/or DHA. The acyl glycerolphosphate acyl transferase (AGPAT) encoded by the gene cluster, e.g. by domain IV*, preferably contained in pfa3, is a specific embodiment of an acyl transferase (AT).

Generally, domain I encodes an amino acid sequence having an identity of at least 85% to one of SEQ ID NO: 12 or 13, SEQ ID NO: 43 or 44, SEQ ID NO: 74 or 75, SEQ ID NO: 108 or 109, SEQ ID NO: 132 or 133, and/or SEQ ID NO: 148 or 149;

domain IIa encodes an amino acid sequence having an identity of at least 85% to one of SEQ ID NO: 15 or 16, SEQ ID NO: 46 or 47, SEQ ID NO: 77 or 78, SEQ ID NO: 111 or 112, and/or SEQ ID NO: 151 or 152;

domain IIb encodes an amino acid sequence having an identity of at least 85% to one of SEQ ID NO: 18 or 19, SEQ ID NO: 49 or 50, SEQ ID NO: 80 or 81, SEQ ID NO: 114 or 115, and/or SEQ ID NO: 154 or 155;

domain IIc encodes an amino acid sequence having an identity of at least 85% to one of SEQ ID NO: 21 or 22, SEQ ID NO: 52 or 53, SEQ ID NO: 83 or 84, SEQ ID NO: 117 or 118, and/or SEQ ID NO: 157 or 158;

domain IIIa encodes an amino acid sequence having an identity of at least 85% to one of SEQ ID NO: 24 or 25, SEQ ID NO: 55 or 56, SEQ ID NO: 86 or 87, SEQ ID NO: 120 or 121, and/or SEQ ID NO: 160 or 161;

domain IIIb encodes an amino acid sequence having an identity of at least 85% to one of SEQ ID NO: 27 or 28, SEQ ID NO: 58 or 59, SEQ ID NO: 89 or 90, SEQ ID NO: 123 or 124, and/or SEQ ID NO: 163 or 164.

Optional domain IV encodes an amino acid sequence having an identity of at least 85% to one of SEQ ID NO: 92 or 93, SEQ ID NO: 126 or 127, and/or SEQ ID NO: 166 or 167.

Preferably, each of the genes, regions and/or domains encodes an amino acid sequence having at least 60%, at least 85%, at least 90%, and preferably at least 95% or at least 98% identity to one or more of the amino acid sequences for each domain as given herein, or as encoded by a nucleic acid sequence for each domain as given herein.

Preferably, the domain IV* encodes an amino acid sequence having a sequence identity of at least 2.5%, preferably of at least 22% or 24%, more preferably of at least 50%, 75% or at least 84%, most preferably of at least 90%, 95% or at least 97% or 98% to one of the amino acid sequences given for domain IV*, e.g. to a domain IV* amino acid sequence contained in the group comprising or consisting of SEQ ID NO: 30 or 31, SEQ ID NO: 61 or 62, and/or a domain IV* amino acid sequence contained in the group comprising or consisting of SEQ ID NO: 95 or 96, SEQ ID NO: 129 or 130, SEQ ID NO: 135 or 136, and/or SEQ ID NO: 169 or 170, or as encoded by a nucleic acid sequence section encoding a domain IV*, e.g. a nucleic acid sequence section contained in the group comprising or consisting of SEQ ID NO: 29, SEQ ID NO: 60, and/or in the group comprising or consisting of SEQ ID NO: 94, SEQ ID NO: 128, SEQ ID NO: 134, and/or SEQ ID NO: 168.

Further, the domain IV* is preferably contained in a nucleic acid sequence encoding the Pfa3 gene product, preferably encoding a Pfa3 having an amino acid sequence identity of at least 30%, at least 32.5%, or at least 35%, preferably at least 40%, at least 42.5%, at least 54%, more preferred at least 84%, 90% or 95% to one of the amino acid sequences contained in the group comprising or consisting of SEQ ID NO: 10 and/or SEQ ID NO: 41, and/or in the group comprising or consisting of SEQ ID NO: 72, SEQ ID NO: 106, and/or SEQ ID NO: 146.

BRIEF DESCRIPTION OF THE SEQUENCE LISTING

Figure 1:
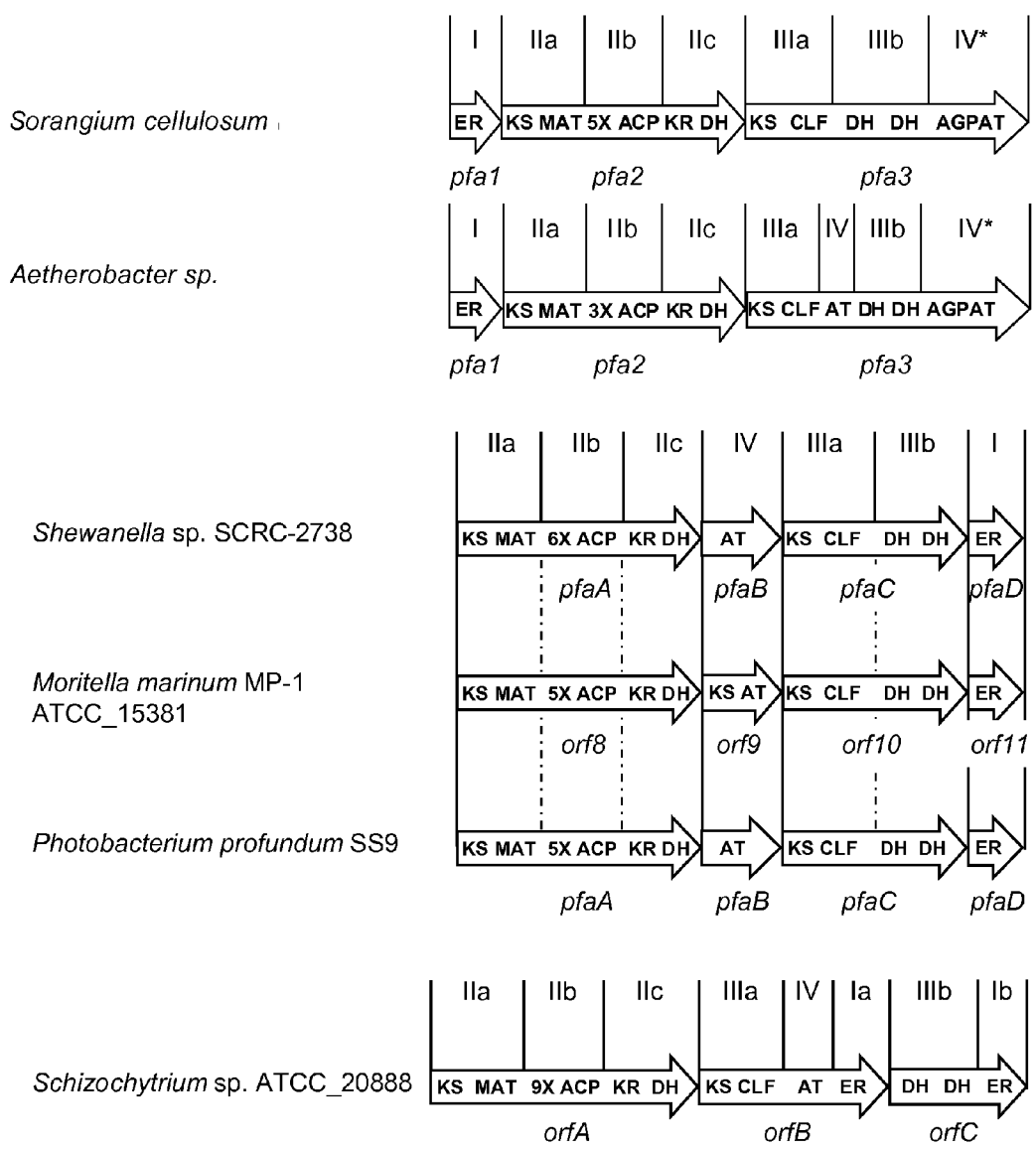
FIG. 1 shows a schematic comparison of gene clusters encoding polyunsaturated fatty acid biosynthetic pathways. The source organisms are mentioned to the left. The abbreviations (protein codes) have the following meanings: ER=enoylreductase; KS=beta-ketoacyl synthase; MAT=malonyl-CoA-transacylase; KR=ketoreductase; DH=dehydratase; CLF=chain length factor; AT=acyltransferase; ACP=acyl carrier protein; AGPAT=acyl glycerolphosphate acyl transferase.

| *Sorangium cellulosum* (Soce56) | |
| --- | --- |
| DNA sequence encoding entire synthesis cluster for PUFA: SEQ ID NO: 1; | nt (nucleotides) 1 . . . 1650 of SEQ ID NO: 1 are codons (CDS) of pfa1 encoding protein: SEQ ID NO: 2 nt 1677 . . . 9389 of SEQ ID NO: 1 are CDS of pfa2 encoding protein: SEQ ID NO: 3 nt 9386 . . . 17176 of SEQ ID NO: 1 are CDS of pfa3 encoding protein: SEQ ID NO: 4 |
| DNA sequence encoding pfa1: SEQ ID NO: 5 | CDS pfa1 encoding protein of SEQ ID NO: 6 |
| DNA sequence encoding pfa2: SEQ ID NO: 7 | CDS pfa2 encoding protein of SEQ ID NO: 8 |
| DNA sequence encoding pfa3: SEQ ID NO: 9 | CDS pfa3 encoding protein of SEQ ID NO: 10 |
| DNA sequence encoding domain I: SEQ ID NO: 11 protein of domain I: SEQ ID NO: 13 | CDS I encoding protein of SEQ ID NO: 12 |
| DNA sequence encoding domain IIa: SEQ ID NO: 14 protein of domain of IIa: SEQ ID NO: 16 | CDS IIa encoding protein of SEQ ID NO: 15 |
| DNA sequence encoding domain IIb: SEQ ID NO: 17 protein of domain of IIb: SEQ ID NO: 19 | CDS IIb encoding protein of SEQ ID NO: 18 |
| DNA sequence encoding domain IIc: SEQ ID NO: 20 protein of domain of IIc: SEQ ID NO: 22 | CDS IIc encoding protein of SEQ ID NO: 21 |
| DNA sequence encoding domain IIIa: SEQ ID NO: 23 protein of domain of IIIa: SEQ ID NO: 25 | CDS IIIa encoding protein of SEQ ID NO: 24 |
| DNA sequence encoding domain IIIb: SEQ ID NO: 26 protein of domain of IIIb: SEQ ID NO: 28 | CDS IIIb encoding protein of SEQ ID NO: 27 |
| DNA sequence encoding domain IV*: SEQ ID NO: 29 protein of domain of IV*: SEQ ID NO: 31 | CDS IV* encoding protein of SEQ ID NO: 30 |

| *Sorangium cellulosum* Soce 377 | |
| --- | --- |
| DNA sequence encoding entire synthesis cluster for PUFA: SEQ ID NO: 32 | nt 1 . . . 1650 of SEQ ID NO: 32 are CDS of pfa1 encoding protein of SEQ ID NO: 33 nt 1677 . . . 9380 of SEQ ID NO: 32 are CDS of pfa2 encoding protein of SEQ ID NO: 34 nt 9377 . . . 17221 of SEQ ID NO: 32 are CDS of pfa3 encoding protein of SEQ ID NO: 35 |
| DNA sequence encoding pfa1: SEQ ID NO: 36 | CDS pfa1 encoding protein of SEQ ID NO: 37 |
| DNA sequence encoding pfa2: SEQ ID NO: 38 | CDS pfa2 encoding protein of SEQ ID NO: 39 |
| DNA sequence encoding pfa3: SEQ ID NO: 40 | CDS pfa3 encoding protein of SEQ ID NO: 41 |
| DNA sequence encoding domain I: SEQ ID NO: 42 protein of domain of I: SEQ ID NO: 44 | CDS I encoding protein of SEQ ID NO: 43 |

-continued

| | |
|---|---|
| DNA sequence encoding domain IIa: SEQ ID NO: 45 | CDS IIa encoding protein of SEQ ID NO: 46 |
| protein of domain of IIa: SEQ ID NO: 47 | |
| DNA sequence encoding domain IIb: SEQ ID NO: 48 | CDS IIb encoding protein of SEQ ID NO: 49 |
| protein of domain of IIb: SEQ ID NO: 50 | |
| DNA sequence encoding domain IIc: SEQ ID NO: 51 | CDS IIc encoding protein of SEQ ID NO: 52 |
| protein of domain of IIc: SEQ ID NO: 53 | |
| DNA sequence encoding domain IIIa: SEQ ID NO: 54 | CDS IIIa encoding protein of SEQ ID NO: 55 |
| protein of domain of IIIa: SEQ ID NO: 56 | |
| DNA sequence encoding domain IIIb: SEQ ID NO: 57 | CDS IIIb encoding protein of SEQ ID NO: 58 |
| protein of domain of IIIb: SEQ ID NO: 59 | |
| DNA sequence encoding domain IV*: SEQ ID NO: 60 | CDS IV* encoding protein of SEQ ID NO: 61 |
| protein of domain of IV*: SEQ ID NO: 62 | |

*Aetherobacter fasciculatus* SBSr002

| | |
|---|---|
| DNA sequence encoding entire synthesis cluster for PUFA: SEQ ID NO: 63 | nt 1 . . . 1608 of SEQ ID NO: 63 are codons (CDS) of pfa1 encoding protein of SEQ ID NO: 64
nt 1644 . . . 8312 of SEQ ID NO: 63 are CDS of pfa2 encoding protein of SEQ ID NO: 65
nt 8309 . . . 16219 of SEQ ID NO: 63 are CDS pfa3 encoding protein of SEQ ID NO: 66 |
| DNA sequence encoding pfa1: SEQ ID NO: 67 | CDS pfa1 encoding protein of SEQ ID NO: 68 |
| DNA sequence encoding pfa2: SEQ ID NO: 69 | CDS pfa2 encoding protein of SEQ ID NO: 70 |
| DNA sequence encoding pfa3: SEQ ID NO: 71 | CDS pfa3 encoding protein of SEQ ID NO: 72 |
| DNA sequence encoding domain I: SEQ ID NO: 73 | CDS I encoding protein of SEQ ID NO: 74 |
| protein of domain I: SEQ ID NO: 75 | |
| DNA sequence encoding domain IIa: SEQ ID NO: 76 | CDS IIa encoding protein of SEQ ID NO: 77 |
| protein of domain IIa: SEQ ID NO: 78 | |
| DNA sequence encoding domain IIb: SEQ ID NO: 79 | CDS IIb encoding protein of SEQ ID NO: 80 |
| protein of domain IIb: SEQ ID NO: 81 | |
| DNA sequence encoding domain IIc: SEQ ID NO: 82 | CDS IIc encoding protein of SEQ ID NO: 83 |
| protein of domain IIc: SEQ ID NO: 84 | |
| DNA sequence encoding domain IIIa: SEQ ID NO: 85 | CDS IIIa encoding protein of SEQ ID NO: 86 |
| protein of domain IIIa: SEQ ID NO: 87 | |
| DNA sequence encoding domain IIIb: SEQ ID NO: 88 | CDS IIIb encoding protein of SEQ ID NO: 89 |
| protein of domain IIIb: SEQ ID NO: 90 | |
| DNA sequence encoding domain IV: SEQ ID NO: 91 | CDS IV encoding protein of SEQ ID NO: 92 |
| protein of domain IV: SEQ ID NO: 93 | |
| DNA sequence encoding domain IV*: SEQ ID NO: 94 | CDS IV* encoding protein of SEQ ID NO: 95 |
| protein of domain IV*: SEQ ID NO: 96 | |

*Aetherobacter* sp. SBSr008

| | |
|---|---|
| DNA sequence encoding entire synthesis cluster for PUFA: SEQ ID NO: 97 | nt 1 . . . 1608 of SEQ ID NO: 97 are CDS of pfa1 encoding protein of SEQ ID NO: 98
nt 1644 . . . 8342 of SEQ ID NO: 97 are CDS of pfa2 encoding protein of SEQ ID NO: 99
nt 18339 . . . 16243 of SEQ ID NO: 97 are CDS of pfa3 encoding protein of SEQ ID NO: 100 |
| DNA sequence encoding pfa1: SEQ ID NO: 101 | CDS pfa1 encoding protein of SEQ ID NO: 102 |
| DNA sequence encoding pfa2: SEQ ID NO: 103 | CDS pfa2 encoding protein of SEQ ID NO: 104 |
| DNA sequence encoding pfa3: SEQ ID NO: 105 | CDS pfa3 encoding protein of SEQ ID NO: 106 |
| DNA sequence encoding domain I: SEQ ID NO: 107 | CDS I encoding protein of SEQ ID NO: 108 |
| protein of domain I: SEQ ID NO: 109 | |
| DNA sequence encoding domain IIa: SEQ ID NO: 110 | CDS IIa encoding protein of SEQ ID NO: 111 |
| protein of domain IIa: SEQ ID NO: 112 | |
| DNA sequence encoding domain IIb: SEQ ID NO: 113 | CDS IIb encoding protein of SEQ ID NO: 114 |
| protein of domain IIb: SEQ ID NO: 115 | |
| DNA sequence encoding domain IIc: SEQ ID NO: 116 | CDS IIc encoding protein of SEQ ID NO: 117 |
| protein of domain IIc: SEQ ID NO: 118 | |
| DNA sequence encoding domain IIIa: SEQ ID NO: 119 | CDS IIIa encoding protein of SEQ ID NO: 120 |
| protein of domain IIIa: SEQ ID NO: 121 | |
| DNA sequence encoding domain IIIb: SEQ ID NO: 122 | CDS IIIb encoding protein of SEQ ID NO: 123 |
| protein of domain IIIb: SEQ ID NO: 124 | |
| DNA sequence encoding domain IV: SEQ ID NO: 125 | CDS IV encoding protein of SEQ ID NO: 126 |
| protein of domain IV: SEQ ID NO: 127 | |
| DNA sequence encoding domain IV*: SEQ ID NO: 128 | CDS IV* encoding protein of SEQ ID NO: 129 |
| protein of domain IV*: SEQ ID NO: 130 | |

*Aetherobacter rufus* SBSr003

| | |
|---|---|
| DNA sequence encoding domain I: SEQ ID NO: 131 | CDS I encoding protein of SEQ ID NO: 132 |
| protein of domain I: SEQ ID NO: 133 | |
| DNA sequence encoding domain IV*: SEQ ID NO: 134 | CDS IV* encoding protein of SEQ ID NO: 135 |
| protein of domain IV*: SEQ ID NO: 136 | |

*Minicystis rosea* SBNa008

| | |
|---|---|
| DNA sequence encoding entire synthesis cluster for PUFA: SEQ ID NO: 137 | nt 1 . . . 1632 of SEQ ID NO: 137 are CDS pfa1 encoding protein of SEQ ID NO: 138
nt 1659 . . . 8327 of SEQ ID NO: 137 are CDS pfa2 encoding protein of SEQ ID NO: 139
nt 18324 . . . 17191 of SEQ ID NO: 137 are CDS pfa3 encoding protein of SEQ ID NO: 140 |
| DNA sequence encoding pfa1: SEQ ID NO: 141 | CDS pfa1 encoding protein of SEQ ID NO: 142 |
| DNA sequence encoding pfa2: SEQ ID NO: 143 | CDS pfa2 encoding protein of SEQ ID NO: 144 |
| DNA sequence encoding pfa3: SEQ ID NO: 145 | CDS pfa3 encoding protein of SEQ ID NO: 146 |
| DNA sequence encoding I: SEQ ID NO: 147 | CDS I encoding protein of SEQ ID NO: 148 |
| protein of domain I: SEQ ID NO: 149 | |

| DNA sequence encoding domain IIa: SEQ ID NO: 150 protein of domain IIa: SEQ ID NO: 152 | CDS IIa encoding protein of SEQ ID NO: 151 |
|---|---|
| DNA sequence encoding domain IIb: SEQ ID NO: 153 protein of domain IIb: SEQ ID NO: 155 | CDS IIb encoding protein of SEQ ID NO: 154 |
| DNA sequence encoding domain IIc: SEQ ID NO: 156 protein of domain IIc: SEQ ID NO: 158 | CDS IIc encoding protein of SEQ ID NO: 157 |
| DNA sequence encoding domain IIIa: SEQ ID NO: 159 protein of domain IIIa: SEQ ID NO: 161 | CDS IIIa encoding protein of SEQ ID NO: 160 |
| DNA sequence encoding domain IIIb: SEQ ID NO: 162 protein of domain IIIb: SEQ ID NO: 164 | CDS IIIb encoding protein of SEQ ID NO: 163 |
| DNA sequence encoding domain IV: SEQ ID NO: 165 protein of domain IV: SEQ ID NO: 167 | CDS IV encoding protein of SEQ ID NO: 166 |
| DNA sequence encoding domain IV*: SEQ ID NO: 168 protein of domain IV*: SEQ ID NO: 170 | CDS IV* encoding protein of SEQ ID NO: 169 |

SEQ ID NO: 1 is the DNA sequence of the entire pfa gene cluster of *Sorangium cellulosum* Soce56 comprising 17176 bp. Gene pfa1 is located from position 1 to position 1650, gene pfa2 is located from position 1677 to position 9389, and gene pfa3 is located from position 9386 to position 17176 and overlaps with pfa2. The protein sequences encoded by genes pfa1, pfa2 and pfa3, respectively, are also shown. SEQ ID NO: 2 is the protein sequence of SEQ ID NO: 1 encoded by gene pfa1, SEQ ID NO: 3 is the protein sequence of SEQ ID NO: 1 encoded by gene pfa2, SEQ ID NO: 4 is the protein sequence of SEQ ID NO: 1 encoded by gene pfa3. Gene pfa1 is separately shown as SEQ ID NO: 5 with the encoded amino acid sequence as SEQ ID NO: 6. Gene pfa2 is separately shown as SEQ ID NO: 7 with the encoded amino acid sequence as SEQ ID NO: 8. Gene pfa3 is separately shown as SEQ ID NO: 9 with the encoded amino acid sequence as SEQ ID NO: 10.

SEQ ID NO: 32 is the DNA sequence of *Sorangium cellulosum* Soce377 comprising 17221 bp, in which gene pfa 1 is located from position 1 to position 1650, gene pfa2 is located from position 1677 to position 9380, and gene pfa3 is located from position 9377 to position 17221 and overlaps with pfa2. The protein sequences encoded by genes pfa1, pfa2 and pfa3, respectively, are also shown. SEQ ID NO: 33 is the protein sequence of SEQ ID NO: 1 encoded by gene pfa1, SEQ ID NO: 34 is the protein sequence of SEQ ID NO: 1 encoded by gene pfa2, SEQ ID NO: 35 is the protein sequence of SEQ ID NO: 1 encoded by gene pfa3. Gene pfa1 is separately shown as SEQ ID NO: 36 with the encoded amino acid sequence as SEQ ID NO: 37. Gene pfa2 is separately shown as SEQ ID NO: 38 with the encoded amino acid sequence as SEQ ID NO: 39. Gene pfa3 is separately shown as SEQ ID NO: 40 with the encoded amino acid sequence as SEQ ID NO: 41.

SEQ ID NO: 63 is the DNA sequence of the entire pfa gene cluster (16219 bp) originating from *Aetherobacter fasciculatus* SBSr002 (DSM 21835). Gene pfa1 is located from position 1 to position 1608, gene pfa2 is located from position 1644 to position 8312, and gene pfa3 is located from position 8309 to position 16219, overlapping with pfa2. The protein sequences encoded by genes pfa1, pfa2 and pfa3, respectively, are also shown. SEQ ID NO: 64 is the protein sequence of SEQ ID NO: 63 encoded by gene pfa1, SEQ ID NO: 65 is the protein sequence of SEQ ID NO: 63 encoded by gene pfa2, SEQ ID NO: 66 is the protein sequence of SEQ ID NO: 63 encoded by gene pfa3. Gene pfa1 is separately shown as SEQ ID NO: 67 with the encoded amino acid sequence as SEQ ID NO: 68. Gene pfa2 is separately shown as SEQ ID NO: 69 with the encoded amino acid sequence as SEQ ID NO: 70. Gene pfa3 is separately shown as SEQ ID NO: 71 with the encoded amino acid sequence as SEQ ID NO: 72.

SEQ ID NO: 97 is the DNA sequence of the entire pfa gene cluster (16243 bp) originating from *Aetherobacter* SBSr008. Gene pfa1 is located from position 1 to position 1608, gene pfa2 is located from position 1644 to position 8342, and gene pfa3 is located from position 8339 to position 16243, overlapping with pfa2. The protein sequences encoded by genes pfa1, pfa2 and pfa3, respectively, are also shown. SEQ ID NO: 98 is the protein sequence of SEQ ID NO: 97 encoded by gene pfa1, SEQ ID NO: 99 is the protein sequence of SEQ ID NO: 97 encoded by gene pfa2, SEQ ID NO: 100 is the protein sequence of SEQ ID NO: 97 encoded by gene pfa3. Gene pfa1 is separately shown as SEQ ID NO: 101 with the encoded amino acid sequence as SEQ ID NO: 102. Gene pfa2 is separately shown as SEQ ID NO: 103 with the encoded amino acid sequence as SEQ ID NO: 104. Gene pfa3 is separately shown as SEQ ID NO: 105 with the encoded amino acid sequence as SEQ ID NO: 106.

SEQ ID NO: 137 is the DNA sequence of the entire pfa gene cluster (17191 bp) originating from *Aetherobacter* SBNa008. Gene pfa1 is located from position 1 to position 1632, gene pfa2 is located from position 1659 to position 8327, and gene pfa3 is located from position 8324 to position 17191, overlapping with pfa2. The protein sequences encoded by genes pfa1, pfa2 and pfa3, respectively, are also shown. SEQ ID NO: 138 is the protein sequence of SEQ ID NO: 137 encoded by gene pfa1, SEQ ID NO: 139 is the protein sequence of SEQ ID NO: 137 encoded by gene pfa2, SEQ ID NO: 140 is the protein sequence of SEQ ID NO: 137 encoded by gene pfa3. Gene pfa1 is separately shown as SEQ ID NO: 141 with the encoded amino acid sequence as SEQ ID NO: 142. Gene pfa2 is separately shown as SEQ ID NO: 143 with the encoded amino acid sequence as SEQ ID NO: 144. Gene pfa3 is separately shown as SEQ ID NO: 145 with the encoded amino acid sequence as SEQ ID NO: 146.

For *Aetherobacter* SBSr003, the following regions of the PUFA synthesis cluster are given: gene I as SEQ ID NO: 131 with the encoded protein as SEQ ID NO: 132 and separately as SEQ ID NO: 133, domain IV* as SEQ ID NO: 134 with the encoded protein as SEQ ID NO: 135 and separately as SEQ ID NO: 136. As SBSr003 is deposited under the Budapest Treaty as DSM 23122 (DSMZ, Deutsche Sammlung von Mikroorganismen and Zellkulturen GmbH, Inhoffenstr. 7b, 38124 Braunschweig, Germany, on 7 Oct. 2009), the PUFA synthetic gene cluster of this bacterium is encompassed for the purposes of the invention. This gene cluster contains the coding sequences given for SBSr003, and preferably extends from its gene I to its domain IV*. Preferably, this gene cluster of DSM 23122 encodes an amino acid sequence having at least 60%, at least 85%, at least 90%, and preferably at least 95% or at least 98% identity to one or more of the amino acid sequences of the PUFA synthetic genes of *Aetherobacter*, especially to the amino acid sequence encoded by SEQ ID NO: 63 (amino acid sequences SEQ ID NO: 64 and 68, SEQ ID NO: 65 and 70, and including SEQ ID NO: 64 and 72), by SEQ ID NO: 97 (amino acid sequences SEQ ID NO: 98 and 102, SEQ ID NO: 99 and 104, and including SEQ ID NO: 100 and 106), and/or to the amino acid sequence encoded by SEQ ID NO: 137 (amino acid sequences SEQ ID NO: 138 and 142, SEQ ID NO: 139 and 144, and including SEQ ID NO: 140 and 146).

DETAILED DESCRIPTION

The inventors have identified myxobacterial PUFA biosynthetic gene clusters from *Sorangium cellulosum* strain 56 (Soce56) and strain 377 (Soce377), as well as from *Aetherobacter fasciculatus* SBSr002 DSM 21835, *Aetherobacter* sp. SBSr008, *Minicystis rosea* SBNa008, and in part from *Aetherobacter rufus* SBSr003. Analysis of the biosynthetic loci of these source organisms shows that the arrangement of the genes as well as the organization of the catalytic domains in the biosynthetic proteins is highly homologous but differ significantly from the published sequences of PUFA gene clusters from various organisms (see FIG. 1).

A first aspect of the invention relates to a process for producing one or more polyunsaturated fatty acids by means of heterologous gene expression, the process comprising the steps:
(i) providing a production organism which comprises a gene cluster encoding a polyunsaturated fatty acid biosynthetic pathway, said gene cluster
being derived from a source organism which differs from the production organism; and encompassing a subsequence ER encoding an enoylreductase and a subsequence AT encoding an acyltransferase, wherein the subsequence AT is located downstream with respect to the subsequence ER;
(ii) growing the production organism of step (i) in the presence of a fermentable carbon source whereby one or more polyunsaturated fatty acids are produced; and
(iii) optionally, recovering the one or more polyunsaturated fatty acids.

The process according to the invention is useful for the production of polyunsaturated fatty acids (PUFAs). The term "polyunsaturated fatty acid" is used herein in the meaning as generally known to the skilled person. Preferably, the polyunsaturated fatty acids are monocarboxylic acids comprising 12 to 30 carbon atoms, more preferably 18 to 24 carbon atoms, particularly preferably 20 or 22 carbon atoms. Preferably, the term "polyunsaturated fatty acid" relates to a long hydrocarbon chain composed of 18 or more carbon atoms having at least 2, preferably at least 3 or at least 4 double bonds and a terminal carboxylate group. Preferably, the polyunsaturated fatty acids comprise at least 2, more preferably at least 3, still more preferably at least 4, at least 5 or at least 6 ethylenically unsaturated groups (C=C double bonds), which are preferably not conjugated with one another. For the purpose of the invention, the term "polyunsaturated fatty acid" also encompasses derivatives of polyunsaturated carboxylic acids such as the hydroxy derivatives and/or the salts. As known in the field, a fatty acid may be esterified to form triglycerides and/or phospholipids as well as sphingolipids. Thus, in one embodiment the present invention also relates to such esterified products. Furthermore, the fatty acid product of the present invention can be free fatty acids. Free fatty acids have a free carboxyl group, are not chemically connected to any other compound including triacylglycerides, phospholipids or sphingolipids, and can be present freely in any compartment of the cell.

In a preferred embodiment, at least 1, more preferably at least 2, still more preferably at least 3 and most preferably all of the ethylenically unsaturated groups have cis-configuration [(Z)-configuration]. Typical polyunsaturated fatty acids are oleic acid, linoleic acid, alpha-linolenic acid, gamma-linolenic acid, dihomo-gamma-linolenic acid, arachidonic acid, 5,8,11,14,17-eicosapentaenoic acid (EPA), docosatetraenoic acid, stearidonic acid, eicosatetraenoic acid (ETE), 7,10,13,16,19-docosapentaenoic acid and 4,7,10,13,16,19-docosahexaenoic acid (DHA). Preferred polyunsaturated fatty acids are selected from the group consisting of (18:3), (18:4), (18:5), (20:3), (20:4), (20:5), (22:3), (22:4), (22:5), and (22:6).

In a particularly preferred embodiment, the polyunsaturated fatty acids are ω-3-polyunsaturated fatty acids. Preferred polyunsaturated fatty acids are selected from the group consisting of (18:3ω-3), (18:4ω-3), (18:5ω-3), (20:3ω-3), (20:4ω-3), (20:5ω-3), (22:3ω-3), (22:4ω-3), (22:5ω-3), and (22:6ω-3). Preferred examples of ω-3-polyunsaturated fatty acids include α-linolenic acid (18:3 ALA), eicosa-cis-5,8,11,14,17-pentaenoic acid (20:5 ω-3 EPA) and docosa-cis-4,7,10,13,16,19-hexaenoic acid (22:6 ω-3 DHA). In a further preferred embodiment the omega-3 unsaturated fatty acids are selected from eicosapentaenoic acid (EPA), docosahexaenoic acid (DHA) and mixtures thereof. These compounds are also known with their trivial names timnodonic acid for EPA and cervonic acid for DHA respectively.

In a particularly preferred embodiment, the one or more polyunsaturated fatty acid(s) is (are) selected from the group consisting of hexadecadienoic acid (16:2), hexadecenoic acid (16:1), hexadecanoic acid (16:0), heptadecenoic acid (17:1ω7), iso-heptadienoic acid (iso-17:2ω5, 11), iso-heptadecenoic acid (iso-17:1ω5), iso-heptadecanoic acid (iso-17:0), iso-3-hydroxy-pentadecanoic acid (iso-3-OH-15:0), γ-linolenic acid (18:3ω6), linoleic acid (18:2ω6), octadecenoic acid (18:1), octadecanoic acid (18:0), 2-hydroxy-heptadecanoic acid (2-OH-17:0), 2-hydroxy-heptadecenoic acid (2-OH-17:1), hydroxy-hexadecanoic acid (2-OH-16:0, 3-OH-16:0), iso-pentadecanoic acid (iso-15:0), and eicosadienoic acid (20:2ω6). According to the process of the invention, one or more polyunsaturated fatty acids are produced. Thus, the process according to the invention typically yields a composition from which the one or more polyunsaturated fatty acids can be recovered and isolated, respectively, as described in optional step (iii).

Preferably, the process according to the invention yields a composition comprising more than one polyunsaturated fatty acid, e.g. a composition of at least 2 or 3 PUFAs, wherein one particular polyunsaturated fatty acid is the main ingredient.

In a preferred embodiment, the content of the one particular polyunsaturated fatty acid amounts to at least 40 wt.-%, more preferably at least 45 wt.-%, still more preferably at least 50 wt.-%, yet more preferably at least 55 wt.-%, even more preferably at least 60 wt.-%, most preferably at least 65 wt.-% and in particular at least 70 wt.-%, based on the total weight of all polyunsaturated fatty acids contained in the composition. In another preferred embodiment, the content of said particular polyunsaturated fatty acid amounts to at least 75 wt.-%, more preferably at least 80 wt.-%, still more preferably at least 82 wt.-%, yet more preferably at least 84 wt.-%, even more preferably at least 86 wt.-%, most preferably at least 88 wt.-% and in particular at least 90 wt.-%, based on the total weight of all polyunsaturated fatty acids contained in the composition.

The invention relates to a process for producing of one or more polyunsaturated fatty acids by means of heterologous gene expression. The term "heterologous gene expression" is known to the skilled person. Preferably, heterologous gene expression is defined as the synthesis of foreign proteins in a host organism (production organism) following transformation of that organism by a vector carrying genes from a different organism (source organism). By "gene expression", it is meant the production of a functional polypeptide through the transcription of a nucleic acid segment into mRNA and translation of the mRNA into a protein. By "heterologous gene expression", it is generally meant that a nucleic acid, not naturally present in the genome of the production organism, is present in the production organism and is operably linked to promoter and terminator nucleic acid sequences in a way so it is expressed in the production organism. The term "operably linked" refers to the association of a gene with a sequence that controls its expression on a single nucleic acid fragment. For example, a promoter is operably linked with a coding sequence when it is capable of regulating the expression of that coding sequence. Also, in the present context heterologous gene expression further relates to the presence of a nucleic acid with a similar function to a naturally present nucleic acid, wherein the expression of said heterologous nucleic acid product changes the fatty acid composition. By heterologous expression of a gene cluster encoding a polyunsaturated fatty acid biosynthetic pathway is meant that several genes are expressed heterologously, whose gene products constitute steps in a pathway, not naturally present in the production organism.

According to step (i) of the process according to the invention, a production organism is provided which comprises a gene cluster encoding a polyunsaturated fatty acid biosynthetic pathway. For the purpose of the specification, the term "gene cluster encoding a polyunsaturated fatty acid biosynthetic pathway" refers to any gene cluster encoding for a biosynthetic pathway that is capable of synthesizing one or more polyunsaturated fatty acids by means of the production organism. By heterologous expression of the gene cluster, several genes are expressed heterologously, whose gene products constitute steps in a pathway, not naturally present in the production organism. The gene cluster may comprise one or more genes each of which may independently encode for a mono- or polyfunctional protein and/or enzyme. For the purpose of the specification a gene is generally regarded as a unit of heredity in a living organism. It is normally a stretch of DNA that codes for a type of protein or for an RNA chain that has a function in the organism. Preferably, a gene is defined as a locatable region of genomic sequence, corresponding to a unit of inheritance, which is associated with regulatory regions, transcribed regions, and/or other functional sequence regions.

Preferably, the gene cluster encompasses at least two genes, more preferably at least 3 genes. Preferably, the gene cluster encompasses at most four genes, more preferably at most 3 genes. In a particularly preferred embodiment, the gene cluster comprises exactly three genes, i.e. consists of three genes and optionally, genetic material in between said three genes.

According to the invention, the gene cluster is derived from a source organism differing from the production organism. In this context, "derived" preferably means that the gene cluster originates from a naturally occurring organism (wild-type) or from a genetically modified organism as source organism. In this regard, "originate" does not necessarily mean that the gene cluster has been biosynthesized by the source organism but should also include biotechnological amplification methods such as PCR and de novo synthesis from suitable building blocks such as phosphoamidites.

When the gene cluster originates from a genetically modified organism as source organism, the genome of said genetically modified organism preferably has a homology with its corresponding naturally occurring organism (wild-type) of at least 90%, more preferably at least 92%, still more preferably at least 94%, yet more preferably at least 96%, even more preferably at least 97%, most preferably at least 98% and in particular at least 99%. For the purpose of the invention, the degree of "homology" is preferably based on a comparison of two sequences using the BLASTn 2.2.22 algorithm from the website, blast.ncbi.nlm.-nih.gov(forward slash)Blast.cgi, which is further described in Zhang Z et al. (2000) J Comput Biol 7:203-214.

Preferably, the number of base pairs (bp) forming the gene cluster according to the invention is within the range of from 5,000 to 30,000 bp, more preferably 7,000 to 28,000 bp, still more preferably 9,000 to 26,000 bp, yet more preferably 11,000 to 24,000 bp, most preferably 13,000 to 22,000 bp and in particular 15,000 to 20,000 bp, or 16,200 to 17,300 bp.

According to the invention, the gene cluster encompasses a subsequence ER encoding an enoylreductase and a subsequence AT encoding an acyltransferase, wherein the subsequence AT is located downstream with respect to the subsequence ER. In this regard "subsequence" of the gene cluster means a DNA sequence located on the gene cluster and within a reading frame, which subsequence is shorter than the overall DNA sequence of the gene cluster. In this regard "downstream" preferably means closer to the 3' end of the DNA sequence. Thus, subsequence AT is located closer to the 3' end than subsequence ER. A skilled person knows which peptides or proteins can be qualified as enoylreductases and acyltransferases, respectively, i.e. which requirements need to be satisfied concerning the biocatalytic activity.

Generally, an enoylreductase is a type of enzyme acting on enoyl groups. Enoylreductases are preferably classified in category EC 1.3 (oxidoreductases acting on the CH—CH group of donors), subcategory EC 1.3.1 (with NAD or NADP as acceptor).

Generally, an acyltransferase is a type of transferase enzyme which acts upon acyl groups. Acyltransferases are preferably classified in category EC 2.3 and comprise the subcategories EC 2.3.1 (acyltransferases transferring groups other than amino-acyl groups), EC 2.3.2 (aminoacyltransferases), and EC 2.3.3 (acyltransferases that convert acyl groups into alkyl groups upon transfer) from which the acyltransferase according to the invention is preferably selected.

According to the invention, subsequence ER and/or subsequence AT do not need to encode separate independent proteins and enzymes, respectively. Rather, it is possible that subsequence ER and/or subsequence AT encode domains of a multifunctional protein/enzyme comprising the respective biocatalytic activity among further biocatalytic activities. Thus, for the purpose of the specification, the expression "encoding a . . . " is synonymous to "encoding a peptide or protein having the activity or functionality of a . . . , optionally among other activities or functionalities".

Preferably, the gene cluster comprises a first gene, a second gene and a third gene, wherein the second gene is located downstream with respect to the first gene; and the third gene is located downstream with respect to the second gene. In a preferred embodiment, the subsequence ER is located on the first gene and/or the subsequence AT, which preferably is AGPAT, is located on the third gene.

In a preferred embodiment of the invention, subsequence ER encodes a monofunctional protein/enzyme which does not comprise further domains exhibiting further biocatalytic activities. According to this preferred embodiment, subsequence ER is preferably located on the first gene, for the purpose of the specification preferably also referred to as "gene pfa1". Thus, heterologous expression of gene pfa1 in the production organism preferably yields a preferably monofunctional protein/enzyme exhibiting enoylreductase activity.

In a preferred embodiment of the invention, subsequence AT encodes a domain of a polyfunctional protein/enzyme which exhibits acyltransferase activity at the domain encoded by subsequence AT and additionally exhibits further biocatalytic activities at further domains encoded by further subsequences. According to this preferred embodiment, subsequence AT is preferably located on the third gene, for the purpose of the specification preferably also referred to as "gene pfa3". Thus, heterologous expression of gene pfa3 in the production organism preferably yields a preferably polyfunctional protein/enzyme exhibiting acyltransferase activity at the domain encoded by subsequence AT as well as additional biocatalytic activities at other domains which in turn are encoded by other subsequences that are also located on gene pfa3.

Preferably, the enoylreductase encoded by subsequence ER has a protein identity with SEQ ID NO: 2 and/or with SEQ ID NO: 6 of at least 46%, more preferably at least 48%, still more preferably at least 50%, yet more preferably at least 52%, even more preferably at least 54%, most preferably at least 56%, and in particular at least 58%.

Preferably, the acyltransferase encoded by subsequence AGPAT has a protein identity with SEQ ID NO: 30 and/or with SEQ ID NO: 31 of at least2.%, more preferably at least 5.0%, more preferably at least 7.5%, still more preferably at least 10%, yet more preferably at least 12.5%, even more preferably at least 15%, most preferably at least 17.5%, and in particular at least 20%, preferably at least 22% protein identity, e.g. as determined by means of the GENEIOUS software and the alignment tool GENEIOUS Alignment, as specified herein.

Preferably, the enoylreductase encoded by subsequence ER has a protein similarity with SEQ ID NO: 2 and/or with SEQ ID NO: 6 of at least 66%, more preferably at least 67%, still more preferably at least 68%, yet more preferably at least 69%, even more preferably at least 70%, most preferably at least 71%, and in particular at least 72%.

Preferably, the acyltransferase encoded by subsequence AGPAT has a protein similarity with SEQ ID NO: 66, SEQ ID NO: 72, SEQ ID NO: 31, SEQ ID NO: 62, SEQ ID NO: 96, SEQ ID NO: 130, SEQ ID NO: 136, and/or with SEQ ID NO: 170 of at least 2.5%, more preferably at least 5.0%, more preferably at least 7.5%, still more preferably at least 10%, yet more preferably at least 15%, even more preferably at least 20%, preferably at least 22%, most preferably at least 25%, and in particular at least 27.5%, preferably determined by means of the GENEIOUS software and the alignment tool GENEIOUS Alignment, as specified herein.

Preferably, subsequence ER has a DNA pairwise identity with SEQ ID NO: 67 and/or with SEQ ID NO: 63 nt 1-1608 of at least 60%, more preferably at least 62%, still more preferably at least 64%, yet more preferably at least 66%, even more preferably at least 67%, most preferably at least 68%, and in particular at least 69%.

Preferably, subsequence AGPAT has a DNA pairwise identity with SEQ ID NO: 63, nt 8309-16219 and SEQ ID NO: 71 and/or with SEQ ID NO: 29, SEQ ID NO: 60, SEQ ID NO: 94, SEQ ID NO: 128, SEQ ID NO: 136 and/or SEQ ID NO: 170 of at least 46%, more preferably at least 48%, more preferably at least 50%, still more preferably at least 52%, yet more preferably at least 54%, even more preferably at least 56%, most preferably at least 58%, and in particular at least 60%, preferably determined by means of the GENEIOUS software and the alignment tool Clustal W, as specified herein. For the purpose of the specification, protein identity is synonymous to protein sequence identity, DNA pairwise identity is synonymous to DNA sequence pairwise identity, and protein similarity is synonymous to protein sequence similarity.

Protein identity, protein similarity and DNA pairwise identity (alignment) are generally preferably determined by means of the GENEIOUS program (see the website geneious.com/) using one of the following alignment tools: GENEIOUS Alignment (Drummond A J, Ashton B, Cheung M, Heled J, Kearse M, Moir R, Stones-Havas S, Thierer T, Wilson A (2009) GENEIOUS Pro v5.4.2, available from the website geneious.com). DNA pairwise identity may be alternatively be determined using the tool Clustal W2.0.11Alignment (Thompson, Nucleic Acids Res. 1994, 4673-4680). The parameter settings for protein sequence comparison are preferably as follows ClustalW Alignment: Cost matrix: BLOSUM, Gap open cost: 10, Gap extend cost: 0.1. The parameter settings for DNA sequence comparison are preferably as follows (A) GENEIOUS Alignment: Cost Matrix: 51% similarity (5.0/−3.0), Gap open penalty: 12, Gap extension penalty: 3, Alignment type: Global alignment with free end gaps, and (B) Clustal W2.0.11 Alignment: Cost matrix: IUB, Gap open cost: 15, Gap extend cost: 6.66.

In a preferred embodiment, the gene cluster according to the invention further encompasses a subsequence KS encoding a ketosynthase (in the following also referred to as ketosynthase ks1), and/or at least one subsequence DH encoding a dehydratase (in the following also referred to as dehydratase dh1). In a preferred embodiment, the gene cluster according to the invention further encompasses a subsequence KS encoding a ketosynthase (in the following also referred to as ketosynthase ks1), a subsequence CLF encoding a chain length factor, and/or at least one subsequence DH encoding a dehydratase (in the following also referred to as dehydratase dh1). A skilled person knows which peptides or proteins can be qualified as ketosynthases, chain length factors, and dehydratases, respectively, i.e. which requirements need to be satisfied concerning the biocatalytic activity. Generally, a beta-ketoacyl synthase is a type of synthase enzyme which synthesizes the carbon chain in a type of Claisen condensation. Beta-ketoacyl synthases are preferably classified in category EC 2.3.1.41. Generally, a chain length factor controls the chain length of the fatty acid to be synthesized. The chain length factor also plays an important role in polyketide synthesis (cf. e.g. Y tang et al., J Am Chem. Soc. 2003, 125(42), 12708-9).

Generally, a dehydratase is a type of enzyme that catalyzes the removal of oxygen and hydrogen from organic compounds in the form of water (dehydration). There are four classes of dehydratases: dehydratases acting on 3-hydroxyacyl-CoA esters (no cofactors); dehydratases acting on 2-hydroxyacyl-CoA esters (radical reaction, [4Fe-4S] cluster containing); dehydratases acting on 4-hydroxyacyl-CoA esters ([4Fe-4S] and FAD containing); and dehydratases containing an [4Fe-4S] cluster as active site (aconitase, fumarase, serine dehydratase), from which the dehydratase according to the invention is preferably selected. Preferably, dehydratases are classified in EC 4.2.1 (hydro-lyases). Preferred examples of dehydratases are hydroxy-acyl-dehydratases, particularly β-hydroxy-acyl-dehydratases. In a preferred embodiment, the dehydratase is selected from the group consisting of Crotonoyl-[acyl-carrier-protein] hydratase (EC 4.2.1.58), 3-hydroxyoctanoyl-[acyl-carrier-protein] dehydratase (EC 4.2.1.59), 3-hydroxydecanoyl-[acyl-carrier-protein] dehydratase (EC 4.2.1.60), 3-hydroxypalmitoyl-[acyl-carrier-protein] dehydratase (EC 4.2.1.61), long-chain-enoyl-CoA hydratase (EC 4.2.1.74), 3-hydroxypropionyl-CoA dehydratase (EC 4.2.1.116), and 4-hydroxybutanoyl-CoA dehydratase (EC 4.2.1.120).

In a preferred embodiment, the subsequence KS, the subsequence CLF, the at least one subsequence DH, and/or the subsequence AT are located on the same gene, preferably the third gene (i.e. pfa3), which preferably encodes a multifunctional protein comprising at least three domains, more preferably at least four domains and particularly preferably at least five domains.

In a preferred embodiment, the third gene encodes for a multifunctional protein having at least four, preferably at least five different functionalities, wherein the subsequences encoding for the individual different functionalities encompass the subsequence AT encoding an acyltransferase and wherein said subsequence AT is located downstream with respect to the other subsequences.

In a preferred embodiment, the gene cluster, preferably the third gene (i.e. pfa3) comprises two subsequences DH encoding two dehydratases, namely dehydratase dh1 and dehydratase dh2, which may be identical or different.

Preferably, the gene cluster further encompasses a subsequence KS encoding a ketosynthase (in the following also referred to as ketosynthase ks2), a subsequence MAT encoding a malonyl-CoA-transacylase, at least one subsequence ACP encoding an acylcarrierprotein (in the following referred to as acp1), a subsequence KR encoding a ketoreductase, and/or a subsequence DH encoding a dehydratase (in the following also referred to as dehydratase dh3). Ketosynthase ks2 may be identical with or different from the above mentioned ketosynthase ks1.

Dehydratase dh3 may be identical with or different from the above mentioned dehydratases dh1 and dh2, respectively.

A skilled person knows which peptides or proteins can be qualified as malonyl-CoA-transacylase, acylcarrierprotein, and ketoreductases, respectively, i.e. which requirements need to be satisfied concerning the biocatalytic activity.

Generally, a malonyl-CoA-transacylase (also referred to as [Acyl-carrier-protein] S-malonyltransferase) catalyzes the transfer of a malonyl group from coenzyme A to an acyl carrier protein. Preferably, malonyl-CoA-transacylases are classified in category EC 2.3.1.39.

Generally, an acyl carrier protein is a small polypeptide to which the growing carbon/or acyl chain is attached via a thioester linkage during the biosynthesis (TDH Bugg (ed.) in, Introduction to Enzym and Coenzyme Chemistry, 2.ed, 2004, Blackwell Publishing).

Generally, a keto reductase is an enzyme which reduces keto groups. Preferably, ketoreductases are classified in category EC 1.1.1.184.

In a preferred embodiment, the subsequence KS, the subsequence MAT, the at least one subsequence ACP, the subsequence KR, and/or the subsequence DH are located on the same gene, preferably the second gene (i.e. pfa2).

In a preferred embodiment, the gene cluster, preferably the second gene (i.e. pfa2) comprises at least two subsequences ACP encoding two acylcarrier proteins, namely acylcarrier protein acp1 and acylcarrier protein acp2, which may be identical or different. In a preferred embodiment, the total number of subsequences ACP encoding acyl carrier proteins is 5 or less (acp1, acp2, acp3, acp4 and acp5). Said 5 or less acyl carrier proteins may be identical or different.

In a particularly preferred embodiment, the gene cluster according to the invention comprises a first gene (pfa1), a second gene (pfa2) and a third gene (pfa3), where the second gene is optionally located downstream with respect to the first gene and the third gene is optionally located downstream with respect to the second gene; and a subsequence ER encoding a peptide or protein exhibiting enoyl reductase activity, a subsequence KS2 encoding a peptide or protein exhibiting ketosynthase activity (ks2), a subsequence MAT encoding a peptide or protein exhibiting malonyl-CoA-transacylase activity, at least one subsequence ACP encoding a peptide or protein exhibiting acylcarrierprotein functionality, a subsequence KR encoding a peptide or protein exhibiting ketoreductase activity, a subsequence DH3 encoding a peptide or protein exhibiting dehydratase activity (dh3), a subsequence KS 1 encoding a peptide or protein exhibiting ketosynthase activity (ks1), a subsequence CLF encoding a peptide or protein exhibiting chain length factor functionality; two subsequences DH1 and DH2 encoding a peptide or protein exhibiting dehydratase activity (dh1 and dh2), and a subsequence AT encoding a peptide or protein exhibiting acyltransferase activity;

where the subsequence ER is preferably located on the first gene (pfa1); the subsequences KS2, MAT, ACP, KR and DH3 are located on the second gene (i.e. pfa2); and subsequences KS1, CLF, DH1, DH2, and AT are located on the third gene (i.e. pfa3).

Preferably, the subsequences have the following order on the gene cluster (upstream-downstream, i.e. 5'-3'): ER, KS2, MAT, nACP, KR, DH3, KS1, CLF, DH1, DH2, AT, where n refers to the number of ACP, preferably 1, 2, 3, 4 or 5.

In a preferred embodiment, the gene cluster according to the invention comprises a subsequence encoding for a protein Pfa1 having a protein identity with SEQ ID NO: 2, SEQ ID NO: 6 and/or with SEQ ID NO: 33, SEQ ID NO: 37 (Soce), and/or SEQ ID NO: 64, SEQ ID NO: 68 (*Aetherobacter*), and/or SEQ ID NO: 98, SEQ ID NO: 102 (Aetherobacter), and/or SEQ ID NO: 138, SEQ ID NO: 142 (*Aetherobacter*) of at least 30%, at least 32.5%, at least 35%, at least 37.5%, at least 40%, more preferably at least 42.5%, at least 44%, still more preferably at least 45%, at least 46.5%, yet more preferably at least 47.5%, even more preferably at least 49%, at least 50%, at least 51.5% most preferably at least 52.5%, and in particular at least 54%, at least 55%, at least 56%, at least 56.5% still more preferably at least 58%, at least 59%, yet more preferably at least 60%, even more preferably at least 62%, most preferably at least 64%, and in particular at least 66%, preferably determined by means of the GENEIOUS software and the alignment tool GENEIOUS Alignment, as specified herein. The protein Pfa1 can be encoded by a DNA sequence having at least 54%, more preferably at least 56%, still more preferably at least 58%, yet more preferably at least 60%, even more preferably at least 62%, most preferably at least 64%, and in particular at least 66% with SEQ ID NO: 5 and/or with SEQ ID NO: 36 (Soce), and/or SEQ ID NO: 67 and/or SEQ ID NO: 101, and/or SEQ ID NO: 141 (*Aetherobacter*), preferably determined by means of the GENEIOUS software and the alignment tool ClustalW, as specified herein.

In a preferred embodiment, the gene cluster according to the invention comprises a subsequence encoding for a protein Pfa2 having a protein identity with SEQ ID NO: 3, SEQ ID NO: 8 and/or with SEQ ID NO: 34, SEQ ID NO: 39 (Soce), and/or SEQ ID NO: 65, SEQ ID NO: 70 (*Aetherobacter*), and/or SEQ ID NO: 99, SEQ ID NO: 104 (*Aetherobacter*), and/or SEQ ID NO: 139, SEQ ID NO: 144 (*Aetherobacter*) of at least 30%, at least 32.5%, at least 35%, at least 37.5%, at least 40%, more preferably at least 42.5%, at least 44%, still more preferably at least 45%, at least 46.5%, yet more preferably at least 47.5%, even more preferably at least 49%, at least 50%, at least 51.5% most preferably at least 52.5%, and in particular at least 54%, at least 55%, at least 56%, at least 56.5% still more preferably at least 58%, at least 59%, yet more preferably at least 60%, even more preferably at least 62%, most preferably at least 64%, and in particular at least 66%, preferably determined by means of the GENEIOUS software and the alignment tool GENEIOUS Alignment, as specified herein. The protein Pfa2 can be encoded by a DNA sequence having at least 54%, more preferably at least 56%, still more preferably at least 58%, yet more preferably at least 60%, even more preferably at least 62%, most preferably at least 64%, and in particular at least 66% with SEQ ID NO: 7 and/or with SEQ ID NO: 38 (Soce), and/or SEQ ID NO: 69 and/or SEQ ID NO: 103, and/or SEQ ID NO: 143 (*Aetherobacter*), preferably determined by means of the GENEIOUS software and the alignment tool ClustalW, as specified herein.

In a preferred embodiment, the gene cluster according to the invention comprises a subsequence encoding for a protein Pfa3 having a protein identity with SEQ ID NO: 4, SEQ ID NO: 10 and/or with SEQ ID NO: 35, SEQ ID NO: 41 (Soce), and/or SEQ ID NO: 66, SEQ ID NO: 72 (*Aetherobacter*), and/or SEQ ID NO: 100, SEQ ID NO: 106 (*Aetherobacter*), and/or SEQ ID NO: 140, SEQ ID NO: 146 (*Aetherobacter*) of at least 28%, at least 31%, at least 34%, at least 35%, at least 37%, at least 40%, more preferably at least 43%, at least 46%, still more preferably at least 48%, at least 50%, yet more preferably at least 52%, even more preferably at least 54% or at least 56%, still more preferably at least 58%, at least 59%, yet more preferably at least 60%, even more preferably at least 62%, most preferably at least 64%, and in particular at least 66%, preferably determined by means of the GENEIOUS software and the alignment tool GENEIOUS Alignment, as specified herein. The protein Pfa3 can be encoded by a DNA sequence having at least 49%, more preferably at least 51%, at least 53.5%, at least 53.5%, still more preferably at least 56%, at least 57%, at least 58.5%, yet more preferably at least 59%, even more preferably at least 61%, most preferably at least 63.5%, and in particular at least 66% with SEQ ID NO: 9 and/or with SEQ ID NO: 40 (Soce), and/or SEQ ID NO: 71 and/or SEQ ID NO: 105, and/or SEQ ID NO: 145 (*Aetherobacter*), preferably determined by means of the GENEIOUS software and the alignment tool ClustalW, as specified herein.

In a preferred embodiment, the gene cluster according to the invention comprises a subsequence having a DNA pairwise identity with SEQ ID NO: 1 and/or with SEQ ID NO: 32 (Soce), and/or with SEQ ID NO: 63, with SEQ ID NO: 97 and/or with SEQ ID NO: 137 (*Aetherobacter*) of at least 49%, more preferably at least 51%, still more preferably at least 53%, more preferably at least 53.5%, yet more preferably at least 55%, still more preferably at least 56%, even more preferably at least 57%, yet more preferably at least 58.5%, most preferably at least 59%, even more preferably at least 61%, most preferably at least 63.5%, and in particular at least 66%, preferably as determined by means of the GENEIOUS software and the alignment tool ClustalW, as specified herein.

Preferably, the number of by of the gene cluster that are encompassed by any of the above subsequences is at least 50%, more preferably at least 55%, still more preferably at least 60%, yet more preferably at least 65%, even more preferably at least 70%, most preferably at least 75% and in particular at least 80%, of the total number of by of the gene cluster.

Generally, the type of production organism that is preferably employed in the process according to the invention is not particularly limited.

Myxobacteria are preferably scientifically classified in the kingdom: bacteria, phylum: Proteobacteria, class: Delta Proteobacteria, order: Myxococcales.

For the purpose of the invention the terms "myxobacteria" and "myxobacterial strain" preferably refer to any species or other members of microorganisms belonging to the order of Myxococcales.

The used term "members" preferably is used for any myxobacterial strain of the invention which is defined as to be a homolog neighbour of *Aetherobacter*.

For the purpose of the invention all used taxonomic relations are in accordances to Brenner D J, et al. (eds.) Bergey's Manual of Systematic Bacteriology, 2nd edn, New York: Springer, especially the methods of the invention are referring to this standard.

Preferably, the genome of the production organism has a GC content of at least 50.0%, more preferably at least 52.5%, still more preferably at least 55.0%, yet more preferably at least 57.5%, even more preferably at least 60.0%, most preferably at least 62.5%, and in particular at least 65.0%.

Preferably, the production organism is selected from the group consisting of gramnegative eubarteria, grampositive eubacteria, fungi and yeasts.

According to the process according to the invention, production proceeds by means of heterologous gene expression in a production organism which comprises a gene cluster derived from a source organism which differs from the production organism.

The minimal prerequisite to satisfy this requirement is that the production organism is not identical with the wild type organism that serves source organism, i.e. the source organism from which the identified gene cluster originates.

In a preferred embodiment, the production organism and the source organism are microorganisms.

As far as the taxonomic degree of relationship is concerned, the production organism and the source organism preferably belong to different species or genera; more preferably to different infratribes, subtribes or tribes; still more preferably to different infrafamilies, subfamilies or families; yet more preferably to different suborders or orders; even more preferably to different subgroups or groups; most preferably to different subclasses or classes; and in particular to different subphyla, phyla, kingdoms or domains.

In a preferred embodiment, the production organism is a prokaryotic organism, preferably selected from gramnegative eubacteria and grampositive eubacteria.

Preferred gramnegative eubacteria include bacteria, proteobacteria, gammaproteobacteria (includes *Pseudomonas, Escherichia, Myxococcus*); particularly preferred are *Pseudomonas putida* (Proteobacteria, Gammaproteobacteria), pseudomonadales, pseudomonadaceae, *Pseudomonas, Escherichia coli* (proteobacteria, gammaproteobacteria), enterobacteriales, enterobacteriaceae, *Escherichia, Myxococcus xanthus* (proteobacteria), deltaproteobacteria, Myxococcales, cystobacterineae, myxococcaceae, myxococcus.

Preferred grampositive eubacteria include actinobacteria; particularly preferred are members of the genera *Corynebacterium, Rhodococcus, Streptomyces, Bacillus, Corynebacterium glutamicum* (bacteria), actinobacteria, actinobacteridae, actinomycetales, corynebacterineae, corynebacteriaceae, *Corynebacterium, Rhodococcus jostii* (bacteria, actinobacteria, actinobacteridae, actinomycetales, corynebacterineae), nocardiaceae, *Rhodococcus, Streptomyces coelicolor* (bacteria, actinobacteria, actinobacteridae, actinomycetales, streptomycineae, streptomycetaceae, *streptomyces*).

In another preferred embodiment, the production organism is an eukaryotic organism, preferably selected from fungi and yeasts.

Preferred fungi and yeasts include *Pichia pastoris* (ascomycota, saccharomycetes, saccharomycetidae, pichiaceae, *pichia*), *Saccharomyces cerevisiae* (ascomycota, saccharomycetes, saccharomycetidae), saccharomycetaceae, *Saccharomyces, hansenula* spp. ascomycota, saccharomycetes, saccharomycetidae), saccharomycetaceae), *Torulaspora* spp. ascomycota, saccharomycetes, saccharomycetidae), saccharomycetaceae), *Yarrowia lipolytica* fungi; dikarya; ascomycota; saccharomyceta; saccharomycotina; saccharomycetes; saccharomycetales; dipodascaceae (including its asexual stage, *Candida lipolytica*).

In a preferred embodiment, the production organism is a methylotrophic or oleaginous yeast, i.e., yeast that has a physiology which allows it to grow on methanol and which also usually accumulates a lot of fatty acids to store energy. Preferred are *Hansenula, Pichia, Candida, Torulopsis, yarrowia* and also the basidiomycete yeast *Rhodotorula*.

Typically, the production organism has GRAS status, i.e. is generally recognized as safe.

According to the process of the invention, the gene cluster is derived from a source organism. The source organism may be any organism comprising a gene cluster that encodes a polyunsaturated fatty acid biosynthetic pathway and encompasses a subsequence ER encoding an enoylreductase and a subsequence AT encoding an acyltransferase, wherein the subsequence AT is located downstream with respect to the subsequence ER.

Preferably, the source organism is selected from myxobacteria.

The myxobacteria are believed to have evolved as a monophyletic group of organisms in the order Myxococcales, a delta subgroup in proteobacteria. At present, 3 suborders (Cystobacterineae, Nannocystineae, and Sorangiineae) are recognized in myxobacteria [Reichenbach H (2005) Order VIII. Myxococcales Tchan, Pochon and Prevot 1948, 398AL. In Brenner D J, et al. (eds.) Bergey's Manual of Systematic Bacteriology, 2nd edn, vol. 2, part C, pp. 1059-1072, New York:Springer]. These suborders are divided into six families, namely Cystobacteraceae, Myxococcaceae, Nannocystaceae, Kofleriaceae, Polyangiaceae, and Phaselicystidaceae.

The family Myxococcaceae is composed of the genera *Myxococcus, Corallococcus* and *Pyxidicoccus*. In the related family Cystobacteraceae, five genera are known (*Cystobacter, Archangium, Hyalangium, Melittangium* and *Stigmatella*). Nannocystaceae of the suborder Nannocsytineae are comprised of the Nannocystis and two marine genera (*Enhygromyxa* and *Plesiocystis*). Its related family Kofleriaceae is composed of the terrestrial genus *Kofleria* and the marine genus *Heliangium*. The family Polyangiaceae encompasses the genera *Jahnella, Chondromyces, Polyangium, Byssovorax*, and *Sorangium*. So far, the latter two are the only known genera of cellulose degraders among the order; most of the other taxa are difficult to isolate and cultivate. The recently discovered genus *Phaselicystis* is the only genus in the recently erected family Phaselicystidaceae [Garcia R O et al. (2009) Int J Syst Evol Microbiol 59:1524-1530]. At present 20 genera are recognizable and validly described in myxobacteria to cover all the known soil and marine isolates.

Myxococcales include the following exemplified suborders which in turn include the following exemplified families, exemplified genera and exemplified species. The source organism is preferably selected from any of the following species:

| suborder | family | genus | species (preferred examples) |
|---|---|---|---|
| Cystobacerineae | | | |
| | Cystobacteraceae | | |
| | | Archangium | |
| | | Cystobacter | |
| | | Hyalangium | |
| | | Melittangium | |
| | | Stigmatella | |
| | Myxococcaceae | | |
| | | Anaeromyxobacter | |
| | | Corallococcus | |
| | | Myxococcus | |
| | | Pyxidiococcus | |
| Nannocystineae | | | |
| | Haliangiaceae (Kofleriaceaea) | | |
| | | Haliangium | |
| | Nannocystaceae | | |
| | | Nannocystis | |
| | | Plesiocystis | |
| | | Enhygromyxa | Enhygromyxa salina |
| Sorangiineae | | | |
| | Phaselicystidaceae | | |
| | | Phaselicystis | |
| | Polyangiaceae | | |
| | | Polyangium | |
| | | Jahnella | |
| | | Chondromyces | |
| | | Byssovorax | Byssovorax cruenta |
| | | Aetherobacter | Aetherobacter fasciculatus (DSM 21835) Aetherobacter rufus (DSM 23122) Aetherobacter sp. (DSM 23098) |
| | | Sorangium | Sorangium cellulosum |

Figure 5:
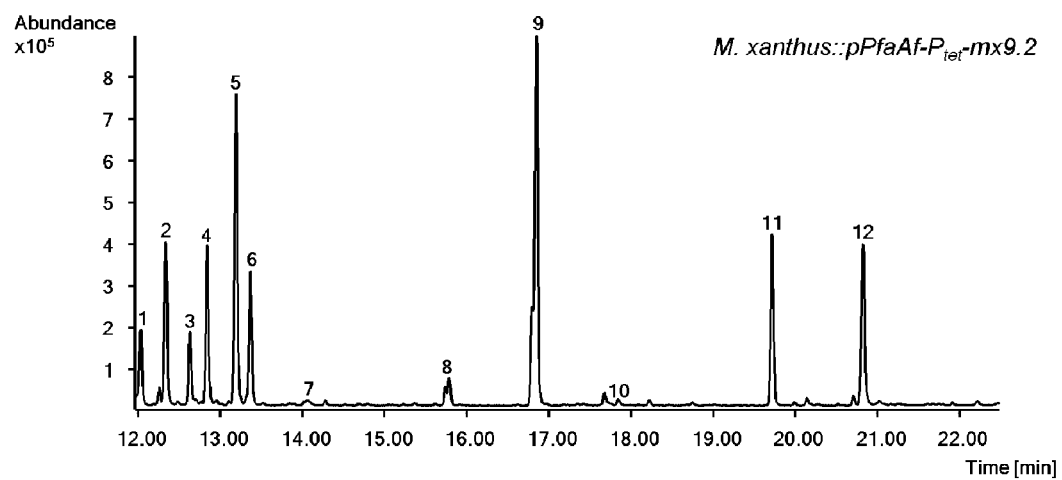
FIG. 5 shows a GC analysis of cellular fatty acid extracts from *M. xanthus* DK1622 wild-type (A) and of cellular fatty acid extracts from *M. xanthus*::pPfaAf-$P_{tet}$-mx9.2 harbouring the gene cluster containing pfa1, pfa2 and pfa3 of SEQ ID NO 63 (B). Cell lipids were hydrolysed and the fatty acids derivatised so they can be analysed by GC-MS. Derivatives of the following fatty acids are shown: hexadecanoic acid (16:0; 1), iso-heptadienoic acid (iso-17:2ω5, 11; 2), heptadecenoic acid (17:1ω7; 3), iso-heptadecenoic acid (iso-17:1ω5; 4), iso-heptadecanoic acid (iso-17:0; 5), iso-3-hydroxy-pentadecanoic acid (iso-3-OH-15:0; 6), hexadecenoic acid (16:1ω7; 7), hydroxy-hexadecanoic acid (2-OH-16:0, 3-OH-16:0; 8), hydroxy-heptadecanoic acid (2-OH-17:0, 3-OH-17:0; 9), eicosapentaenoic acid (20:5ω3, 6, 9, 12, 15; 10), iso-pentadecanoic acid (iso-15:0; 11), and docosahexaenoic acid (22:6ω3, 6, 9, 12, 15, 18; 12).
Figure 5:
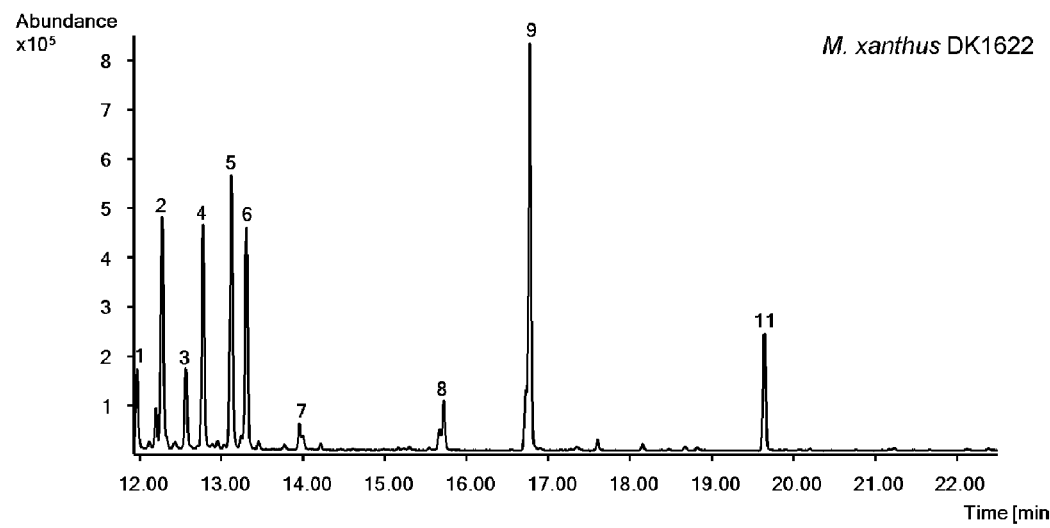
Figure 6:
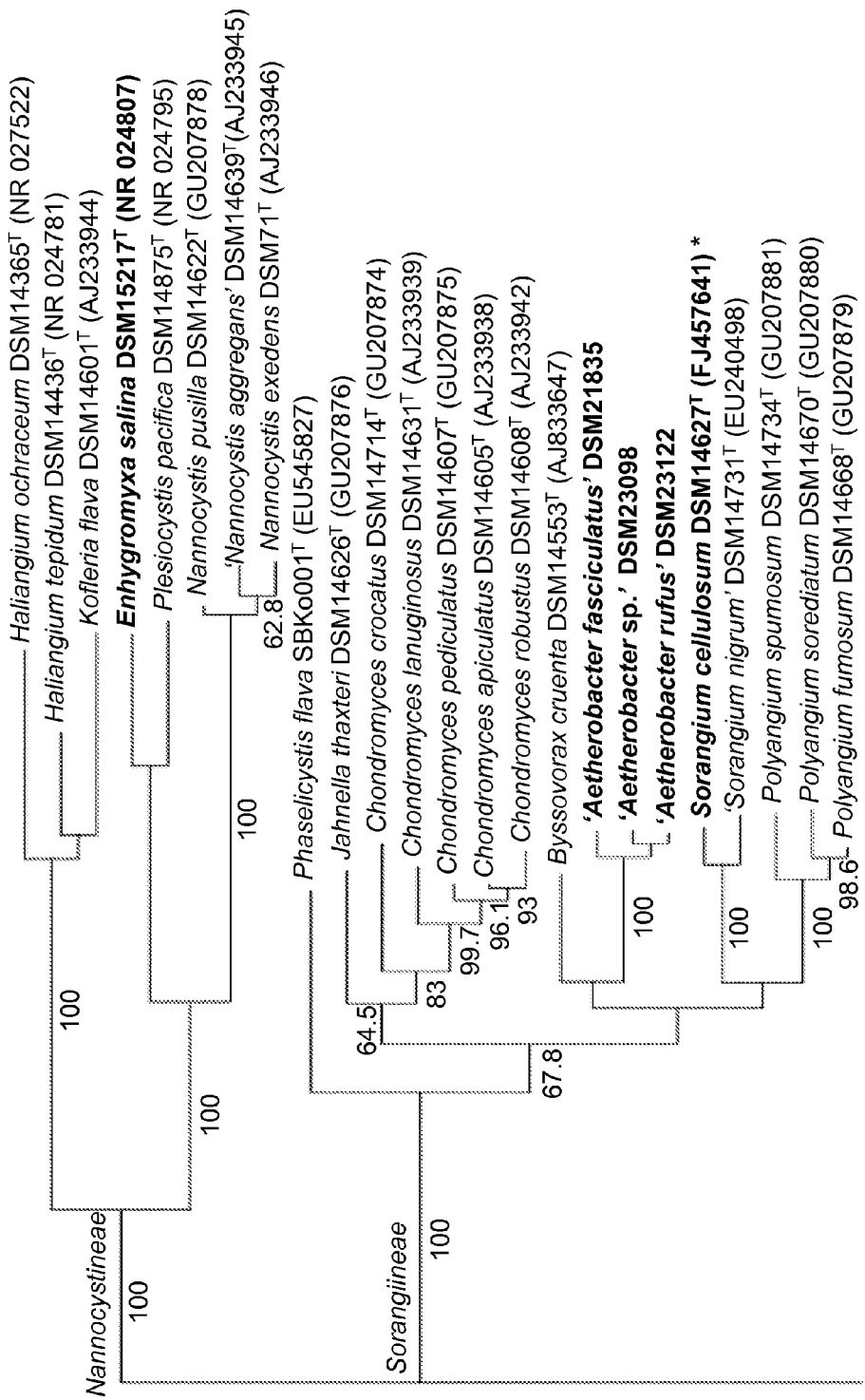
FIG. 6 shows a neighbour joining tree generated from NCBI-BLASTn showing the affinities of the 16S rDNA sequences of *Aetherobacter fasciculatus*.
Figure 7:
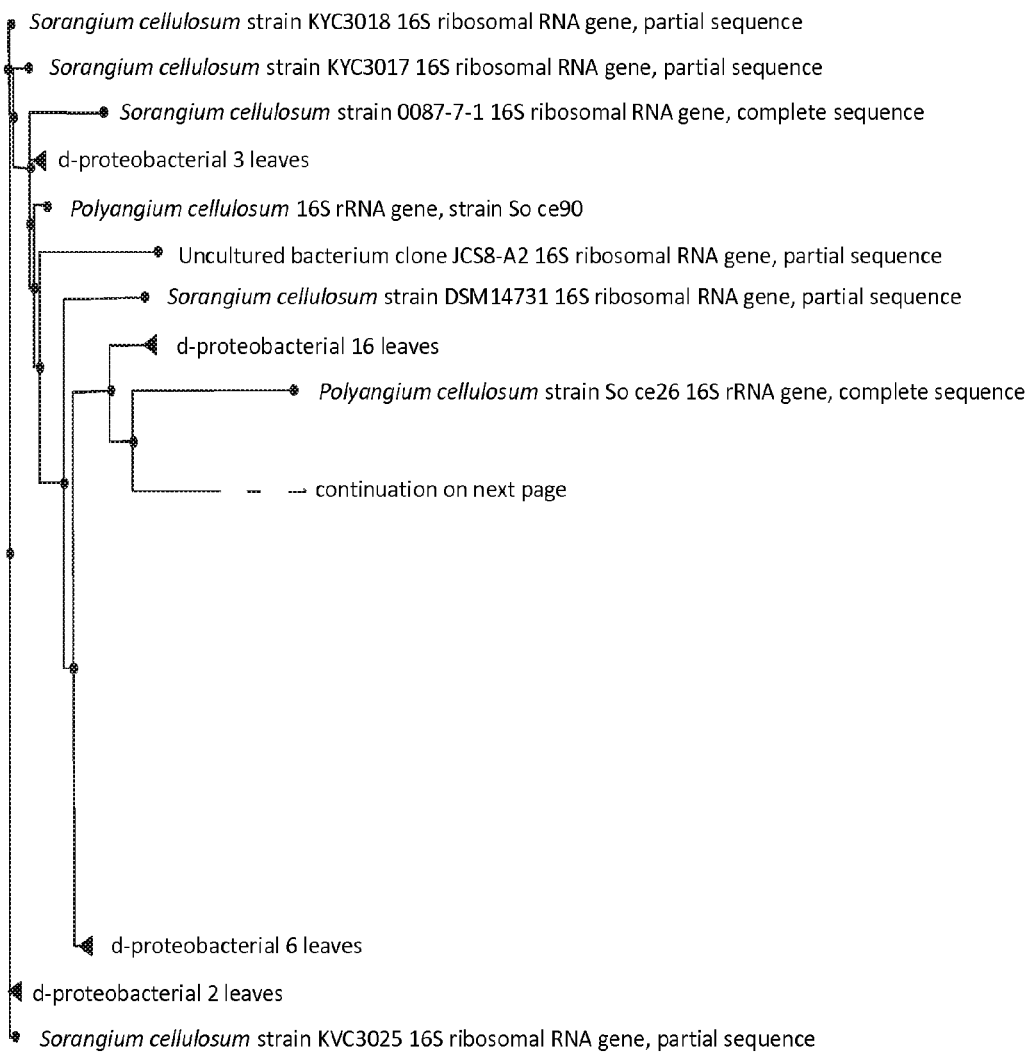
FIG. 7 shows a neighbour joining tree based on myxobacterial 16S rDNA gene sequence, and showing phylogenetic position of EPA and DHA producing strains of *Sorangium cellulosum*.

The phylogenetic relationships as inferred from a comparison of 16S rDNA sequence data of representative genera and species of which viable cultures are extant, are presented in FIG. 5.

In a preferred embodiment, the gene cluster is derived from a myxobacterial strain belonging to the suborder Sorangiineae of the order Myxococcales. In another preferred embodiment, the gene cluster is derived from a myxobacterial strain belonging to the suborder Polyangiaceae of the order Myxococcales. In a preferred embodiment, the myxobacterial strain is selected from *Aetherobacter fasciculatus* DSM 21835, *Aetherobacter rufus* DSM 23122, and *Aetherobacter* sp. strain DSM 23098. In another preferred embodiment, the myxobacterial strain is *Sorangium cellulosum* So ce56.

In a preferred embodiment, the gene cluster is derived from a myxobacterial strain producing a composition comprising polyunsaturated fatty acids, wherein the content of omega-3 polyunsaturated fatty acids is at least 10%, preferably at least 15% by weight of total cellular fatty acid content of the composition.

Once a desired gene cluster of a source organism has been identified and isolated, it can be expressed in a production organism. For the purpose of heterologously expressing such gene cluster in a production organism, it is operably linked to a promoter and a terminator sequence using standard cloning techniques or standard in vitro procedures, such as fusion by PCR. The term "promoter" refers to a DNA sequence capable of controlling the expression of a gene. Constructs containing gene clusters of interest can be introduced into the production organism by standard techniques. These techniques include transformation, such as for example, in *S. cerevisiae*, lithium acetate transformation, spheroplasting, and use of a kar1#15 mutant (Georgieva, B. et al, (2002) Meth. Enzymol. 350: 278-89), protoplast fusion, lipofection, transfection, transduction, conjugation, infection, bolistic impact, electroporation, or any other method that introduces the foreign DNA into the production organism cell. For simplicity, a production organism manipulated in this way will be referred to as "transformed", "recombinant" or "genetically modified". The construct that is introduced into the production organism preferably contains in addition to the expression cassette a marker gene, which allows identification of transformed cells and, in the case of extrachromosomal expression, also prevents the cell from loosing the construct.

Step (ii) of the process according to the invention comprises growing the production organism of step (i) in the presence of a fermentable carbon source whereby one or more polyunsaturated fatty acids are produced.

Typically, production organisms are fermented in a nutrient medium containing a fermentable carbon source and a proteinaceous material. Preferred carbon sources include glucose, brown sugar, sucrose, glycerol, starch, corn starch, lactose, dextrin, molasses, and the like. Preferred nitrogen sources include cottonseed flour, corn steep liquor, yeast, autolysed brewer's yeast with milk solids, soybean meal, cottonseed meal, corn meal, milk solids, pancreatic digest of casein, distillers' solids, animal peptone liquors, meat and bone scraps, and the like. Combinations of these carbon and nitrogen sources can be used advantageously. There is no need to add trace metals, e.g. zinc, magnesium, manganese, cobalt, iron and the like to the fermentation medium since tap water and unpurified ingredients are used as medium components.

Preferably, the fermentable carbon source is free of fatty acids, preferably it is selected from the group consisting of monosaccharides, oligosaccharides, polysaccharides, methanol and carbon-containing amines.

Large scale fermentation for production cultures can be induced at any temperature conductive to satisfactory growth of the production organisms between about 18° and 32° C. and preferably at about 28° C. Ordinarily, optimum production of compounds is obtained in about 2 to 8 days of fermentation, and preferably in about 4 to 5 days of fermentation.

Production can be carried out in shake flasks but also in solid media and stirred fermentors. When growth is carried out in shake flasks or large vessels and tanks, it is preferable to use the vegetative form, rather than the spore form of the production organisms for inoculation. This avoids a pronounced lag in the production of the PUFA compounds and the attendant inefficient utilisation of the equipment. Accordingly, it is desirable to produce a vegetative inoculum in an aqueous nutrient medium by inoculating this medium with an aliquot from a soil or a slant culture. When a young, active vegetative inoculum has thus been secured, it is transferred aseptically to other shake flasks or other suitable devices for fermentation of production organisms. The medium in which the vegetative inoculum is produced can be the same as, or different from, that utilised for the production of compounds, as long as adequate growth of the microorganism is obtained.

In general, seeding of bacterial strains and fermentation and the production of compounds in submerged aerobic fermentation in stirred vessels is utilised. The production is independent of used containers, fermentors and starter proceedings. The compounds can also be obtained by shake-flask culture, or in other specially designed vessels such as airlift or Biowave fermentation tanks. For large volume fermentations it is preferable to use a vegetative inoculum. The vegetative inoculum is prepared by inoculating small volume of culture medium with the spore form or a lyophilised pellet of the organism. The vegetative inoculum is then transferred to a fermentation vessel where, after a suitable incubation time, compounds are produced in optimal yield.

As is customary in aerobic submerged culture process, sterile air is dispersed through the culture medium. For efficient growth of the organism, the volume of the air used is in the range of from about 0.25 to about 0.5 vvm. An optimum rate in a 10 l vessel is about 0.3 vvm with agitation provided by conventional impellers rotating at about 240 rpm. Adding of small amount (i.e. 1 ml/l) of an antifoaming agent such as silicone to fermentations media is necessary if foaming becomes a problem. For microaerophilic organisms it may be favourable to reduce the aeration further in order to support biomass production. The fermentation is usually carried out in batch mode, but to attain better growth and increased product yield, fed-batch fermentations can be carried out by supplying the required nutrient source to a growing culture once it has been depleted in the original culture medium.

The desired products will usually be present mostly in the biomass of the fermented bacterial strains, but in case of their overproduction, they may as well be located in the culture filtrate of the fermentation broth. The culture broth can be separated by filtering on a filter press.

Step (iii) of the process according to the invention is optional only and comprises the recovery of the one or more polyunsaturated fatty acids produced in step (ii).

Suitable methods for the recovery of fatty acids are known to the skilled person and include extraction, chromatography and the like. In particular, a variety of procedures can be employed to isolate and purify the PUFA compounds from the fermentation broth, for example, by chromatographic adsorption procedures followed by elution with a suitable solvent, column chromatography, partition chromatography, by supercritical fluid extraction, and combinations of the aforementioned methods.

A further aspect of the invention relates to a method for producing one or more polyunsaturated fatty acids by means of heterologous gene expression of genes encoding the biosynthetic pathway enzymes for PUFA synthesis as described herein, the method preferably comprising the steps of:

(i) providing a production organism which comprises a gene cluster encoding a polyunsaturated fatty acid biosynthetic pathway, said gene cluster being derived from a source organism which differs from the production organism; and encompassing a first subsequence and/or a second subsequence, wherein the protein encoded by said first subsequence has a protein identity with the amino acid sequence of Pfa1 of at least 46%, more preferably at least 48%, still more preferably at least 50%, yet more preferably at least 52%, even more preferably at least 54%, most preferably at least 56%, and in particular at least 58%; preferably determined by means of the GENEIOUS software and the alignment tool GENEIOUS Alignment, as specified in further detail herein; and/or encoding a protein having a protein identity with the amino acid sequence of Pfa2 of at least 2.5%, more preferably at least 5.0%, more preferably at least 7.5%, still more preferably at least 10%, yet more preferably at least 12.5%, even more preferably at least 15%, most preferably at least 17.5%, and in particular at least 20%; and/or the protein encoded by said second subsequence has a protein identity with the amino acid sequence of Pfa3 of at least 2.5%, more preferably at least 5.0%, more preferably at least 7.5%, still more preferably at least 10%, yet more preferably at least 12.5%, even more preferably at least 15%, most preferably at least 17.5%, and in particular at least 20%; preferably determined by means of the GENEIOUS software and the alignment tool GENEIOUS Alignment, as specified in further detail herein;
(ii) growing the production organism of step (i) in the presence of a fermentable carbon source whereby one or more polyunsaturated fatty acids are produced; and
(iii) optionally, recovering the one or more polyunsaturated fatty acids.

Preferably, the first subsequence is subsequence ER as described above and/or the second subsequence is subsequence AT as described above.

All preferred embodiments that have been described in connection with the first aspect of the invention (process according to the invention) also refer analogously to this aspect of the invention (method according to the invention) and thus, are not repeated hereinafter.

A further aspect of the invention relates to a composition comprising at least two different polyunsaturated fatty acids obtainable by the process according to the invention and the method according to the invention, respectively.

The phylogeny is in accordance with the morphological and physiological characteristics of myxobacteria. Most importantly, fatty acid profiles as inferred from GC-MS analyses of the cellular fatty acid content are generally used and deemed acceptable for taxonomic segregation of Myxobacteria, as well as many other groups of bacterial organisms, since they were found to be a constant feature, at least when standardised methodology is applied. First applications of this technique have been made in the early 1980s [Tornabenet G (1985) Methods in Microbiology 18, 209-234]. Therefore, such GC-MS (or GC-) based fatty acid profiles have been widely used in bacterial phylogeny and taxonomy.

Thus, gene clusters derived from different individual competent species, i.e. different species that are capable of producing PUFAs, yield products of different composition, i.e. products containing different PUFAs and/or PUFAs in different amounts. Thus, the products obtainable by the different processes have individual characteristics distinguishing them from one another.

A further aspect of the invention relates to a transformed production organism which comprises a gene cluster encoding a polyunsaturated fatty acid biosynthetic pathway as defined above.

The invention is now described in greater detail with reference to the figures and by way of examples which, however, are not to be construed as limiting the scope of the claims.

*Aetherobacter fasciculatus*, currently also termed SBSr002, was deposited according to the Budapest Treaty at the DMSZ, Deutsche Sammlung von Mikroorganismen und Zellkulturen GmbH, Inhoffenstr. 7 B, 38124 Braunschweig, Germany on Aug. 27, 2008 with the deposition number DSM 21835. *Aetherobacter rufus*, currently also termed SBSr003, was deposited with DSMZ under deposition number DSM 23122, and *Aetherobacter* sp, currently also termed SBSr008, was deposited with DSMZ under deposition number DSM 23098 with DSMZ on 12 Nov. 2009.

*A. fasciculatus* DSM 21835 was identified as member of class Myxobacteria, order Myxococcales by showing characteristic swarming of Gram-negative, slender rod-shaped vegetative cells, fruiting body formation, and bacteriolytic activity. The strain is aerobic to facultative aerobic, chemoheterotrophic, and also exhibits resistance to various antibiotics. Major fatty acids are C22:6 (docosahexaenoic acid), iso-C15:0, ante-iso C17:0 and C20:5 (eicosapentaenoic acid). The G+C content of the genomic DNA is 68.9 mol %. The 16S rDNA sequence shows 96% identity to the cellulose-degrading *Byssovorax crueta* and 95% to *Sorangium cellulosum*. This clearly shows that the strain belongs to the suborder Sorangiineae of the order Myxococcales. In addition, uniqueness in morphological growth stages and novel fatty acid profile, clearly implies that DSM 21835 belongs to a new taxon which is proposedly classified as belonging to the novel genus Aetherobacter and in the novel species *A. fasciculatus*

EXAMPLE 1

Figure 2:
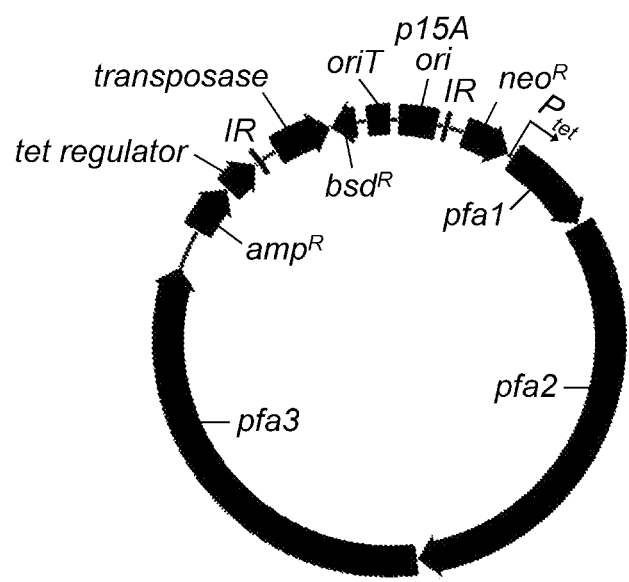
FIG. 2 shows a nucleic acid construct for the heterologous expression of the PUFA biosynthetic gene cluster from *Sorangium cellulosum* So ce56 in another myxobacterium e.g. *Myxococcus xanthus* DK1622. PUFA biosynthetic genes (pfa1, pfa2 and pfa3) are under control of the Ptet promoter, the construct is randomly integrated into the host chromosome via transposon-mediated gene cluster transfer. transposase: gene encoding the transposase, IR: inverted repeat, ampR: ampicillin resistance gene, bsdR: blasticidin resistance gene, neoR: kanamycin resistance gene, tet regulator: gene that encodes the repressor of the Ptet promoter, Ptet: tetracycline inducible promoter, oriT: origin of transfer.

Generation of an Expression Construct for a Biosynthetic Gene Cluster for Encoding for the Production of PUFAs a) Subcloning of PUFA Genes and Construction of Expression Constructs:

The PUFA genes were subcloned from the chromosomes of PUFA-producing myxobacterial strains by generating genomic libraries (e.g. using cosmid, fosmid, YAC or BAC vectors) or by amplifying PUFA genes or fragments thereof by PCR followed by subcloning of the PCR products. Alternatively, the PUFA genes were subcloned using methods relying on recombination, e.g. the Red/ET recombination technology (Zhang Y, Nat. Genet. 1998, 20:123-128; Zhang Y, Nat. Biotechnol. 2000, 18:1314-1317) or recombination in yeast (Kouprina N, Nature Protocols 2008, 3:371-377; Larionov V, P. Natl. Acad. Sci. USA 1996, 93:491-496; Wolfgang M C, Proc. Natl. Acad. Sci. U.SA 2003, 100:8484-8489). In another approach the native or artificial DNA sequences of PUFA genes were chemically synthesized de novo (e.g. by gene synthesis, which is available commercially). A preferred plasmid containing the entire gene cluster of pfa1, pfa2, pfa3 is shown in FIG. 2. The IR elements flanking the gene cluster are optional and preferred for co-transformation of the plasmid section containing the gene cluster and flanking IR elements with a gene encoding a transposase, which can be contained in the same or in a separate nucleic acid construct.

To mobilize the PUFA genes the expression construct was modified with genetic elements enabling the transfer, propagation and control of expression in the heterologous host. For the transfer via conjugation an origin of transfer (oriT) is added to the expression construct. For propagation of the PUFA genes in the host cell, the expression constructs were either equipped with an origin of replication, which is functional in the host strain, or the expression construct was integrated into the host chromosome using diverse methods. To randomly integrate the PUFA genes into the host chromosome by transposition (Fu J, Nucleic Acids Res. 2008, 36:e113), the PUFA biosynthetic gene cluster together with a suitable selection marker is flanked by inverted repeat elements (IRs) and the expression construct contains the transposase from the mariner transposon pMycoMar (see FIG. 2) (Rubin E J, P. Natl. Acad. Sci. USA 1999, 96:1645-1650). Directed integration into the host chromosome was achieved by homologous recombination or via host specific phage attachment sites catalyzed by dedicated integrases (e.g. Mx8 or Mx9 attachment sites in myxobacteria (Magrini V. J. Bacteriol. 1999, 181:4050-4061; Julien B, J. Bacteriol. 2003, 185:6325-6330), or the ΦC31 attachment site in actinomycetes (Kieser T: Practical *Streptomyces* Genetics. Norwich, England: The John Innes Foundation; 2000)).

b) Modification of the PUFA Biosynthetic Gene Cluster:

To enable and/or optimize heterologous expression, the PUFA biosynthetic gene cluster was modified by engineering genetic elements involved in transcription/translation (e.g. engineering of promotors or ribosome binding sites) or by adapting the PUFA gene codons towards the codon usage of the heterologous host. For the heterologous expression in myxobacteria, the native promoter structures were exchanged for the PT7A1, Pm, Ptet (see FIG. 2), the tn5-derived npt promotor or other promotors (e.g. promotors driving the expression of native secondary metabolite pathways). To optimize the PUFA production profile the myxobacterial PUFA biosynthetic machineries were engineered (e.g. mutation/insertion/deletion/exchange of catalytic domains) by modifying the biosynthetic genes.

EXAMPLE 2

Transfer of the Gene Cluster into a Host Organism for Heterologous Production of PUFAs The expression constructs of the myxobacterial PUFA biosynthetic gene clusters were transferred into the heterologous host strains by electroporation, conjugation or other transformation methods (e.g. protoplast/spheroblast transformation or using natural competency). The transformants were analyzed genotypically for the presence (and correct integration) of the PUFA gene containing constructs. The host strains containing the myxobacterial PUFA biosynthetic gene clusters were cultivated under appropriate conditions (e.g. for M. xanthus: CTT medium at 30° C. for 2-4 days). PUFA production was analyzed by gas chromatography coupled mass spectrometry (GC-MS) using the FAME method, e.g. analysis of fatty acids methyl esterification.

EXAMPLE 3

Generation of an Expression Construct for the PUFA Biosynthetic Gene Cluster from Aetherobacter fasciculatus DSM 21835 by Conventional Cloning Methods The PUFA biosynthetic gene cluster from Aetherobacter fasciculatus DSM 21835 was amplified by PCR from chromosomal DNA. For this, the gene cluster was divided into several regions, which were amplified individually while suitable restriction sites were introduced with the primer sequences. In total, 7 fragments were amplified by PCR: the complete gene pfa1 without its native promoter sequence (1, SwaI-SpeI-pfa1-HpaI), the 5' end of gene pfa2 (2, HpaI-5' pfa2-HindIII), the centre section of gene pfa2 (3, HindIII-CRpfa2-NheI), the 3' end of gene pfa2 (4, NheI-3' pfa2-AseI), the 5' end of gene pfa3 (5, AseI-5' pfa3-HindIII), the centre section of gene pfa3 (6, HindIII-CRpfa3-NheI), and the 3' end of gene pfa3 (7, NheI-3' pfa3-SspI-PacI). The PCR products were then subcloned by conventional restriction and ligation methods into a high copy cloning vector (e.g. pUC18 derivative). Subcloning of fragment 1 lead to plasmid pPfa1, subcloning of fragments 2-4 into the same vector generated plasmid pPfa2 and subcloning of fragments 5-7 into the same vector provided plasmid pPfa3. In the next step, the three PUFA biosynthetic genes (pfa1, pfa2 and pfa3) were subcloned onto the same plasmid. For this, genes pfa2 and pfa3 were ligated into the pPfa1 plasmid harbouring the gene pfa1 generating the construct pPfa1-2-3. Genetic elements required for the expression of the pfa genes in the heterologous host (promoter sequences, regulator genes, ribosome binding sites) were ligated via the SwaI-SpeI restriction sites deriving from fragment 1. Cassettes required for the transfer and replication or integration in the host chromosome were introduced via unique restriction sites of plasmid pPfa1-2-3.

EXAMPLE 4

Generation of an Expression Construct for the PUFA Biosynthetic Gene Cluster from Aetherobacter fasciculatus DSM 21835 by Genetic Recombineering Techniques The PUFA biosynthetic gene cluster was directly subcloned from chromosomal DNA from A. fasciculatus DSM 21835 by recombineering techniques. For this, the genomic DNA was digested with restriction enzymes cutting in the flanking regions of the PUFA biosynthetic gene cluster revealing a mixture of genomic DNA fragments. A cassette containing an origin of replication as well as a selection marker (e.g. p15Aori-cmR from pACYC184 or p15Aori-ampR from pACYC177) was amplified by PCR and homology arms to both ends of the genomic DNA fragment harbouring the PUFA biosynthetic gene cluster were introduced with the primer sequence. In addition, unique restriction sites (e.g. PacI) for later subcloning of transfer cassettes were introduced together with the homology arm of the 3' end of the gene cluster. The genomic DNA fragment harbouring the PUFA biosynthetic gene cluster was then subcloned into the PCR product by in vivo double homologous recombination. The recombinant construct was further modified by a second double homologous recombination step to integrate a resistance gene amplified by PCR and flanked by two homology arms and restriction sites (e.g. SwaI and SpeI) at the 5' end of the PUFA biosynthetic gene cluster. The obtained construct was then further engineered by conventional cloning methods to introduce cassettes required for the transfer and the heterologous expression: Genetic elements required for the expression of the pfa genes in the heterologous host (promoter sequences, regulator genes, ribosome binding sites) were ligated via the SwaI-SpeI restriction sites and cassettes required for the transfer and replication or integration in the host chromosome were introduced via unique restriction sites at the 3' end of the PUFA biosynthetic gene cluster.

EXAMPLE 5

Transformation of the PUFA Biosynthetic Gene Cluster from Aetherobacter fasciculatus DSM 21835 into Host Organisms and Heterologous Expression M. xanthus was grown in CTT medium (10 g/L casitone, 10 ml/L Tris buffer, 1 mL/L potassium phosphate buffer (pH 7.6; 86 mL 1M $K_2HPO_4$+13.4 mL 1M $KH_2PO_4$), 10 mL/L 0.8 M magnesium sulfate) at 30° C. until the $OD_{600}$ of 0.5 was reached. 10 mL of the bacterial culture were centrifuged at 13.000 rpm at 4° C., the cell pellet was washed twice with ice cold distilled water and finally resuspended in 40 µL ice cold water. The cell suspension was then electroporated with the expression construct in an ice cold 0.1 cm electroporation cuvette under following conditions: 400Ω, 25 µF and 650 V to achieve a pulse length of 8-9 ms. 1 mL CTT medium was then added and the cells were incubated for 18 h at 30° C. 3 mL of CTT soft agar (CTT medium plus 7.5 g/L agar) containing 25 µL of 50 mg/mL kanamycin was added to the culture and the mixture was poured onto the surface of CTT agar plates (CTT medium plus 15 g/L agar). The plates were incubated for 3 days at 30° C. until mutant colonies appeared. The transformants were then genotypically and phenotypically analyzed.

EXAMPLE 6

Heterologous Production of PUFAs

*M. xanthus* mutants harbouring the PUFA biosynthetic gene cluster were grown in CTT medium supplemented with 50 µg/mL kanamycin at 30° C. for 3-5 days. The culture was centrifuged and PUFAs were extracted. The cellular fatty acids were extracted using the FAME method [Bode H B et al. (2006) J. Bacteriol 188:6524-6528; Ring M W et al. (2006), J Biol Chem 281:36691-36700 (2006)]. Aliquots (1 µL) of the extracts were analysed by GC-MS. Identification of cellular fatty acids including EPA and DHA: Cellular fatty acids including the omega-3 PUFAs (EPA and DHA) were identified based on the fragmentation patterns and retention time. These fatty acids (FA) were compared to FAME mix reference standard (Sigma-Aldrich) which contains 37 fatty acid methyl esters. The presence of DHA and EPA were confirmed using reference standards from Sigma-Aldrich (cis-4,7,10, 13,16,19-DHA, cis-5,8,11,14,17-EPA).

The nucleic acid construct for the heterologous expression of the PUFA biosynthetic gene cluster from *Sorangium cellulosum* So ce56 can be used for heterologous expression of the synthetic gene products in eubacteria or in other myxobacteria, e.g. Myxococcus xanthus DK1622.

Figure 3:
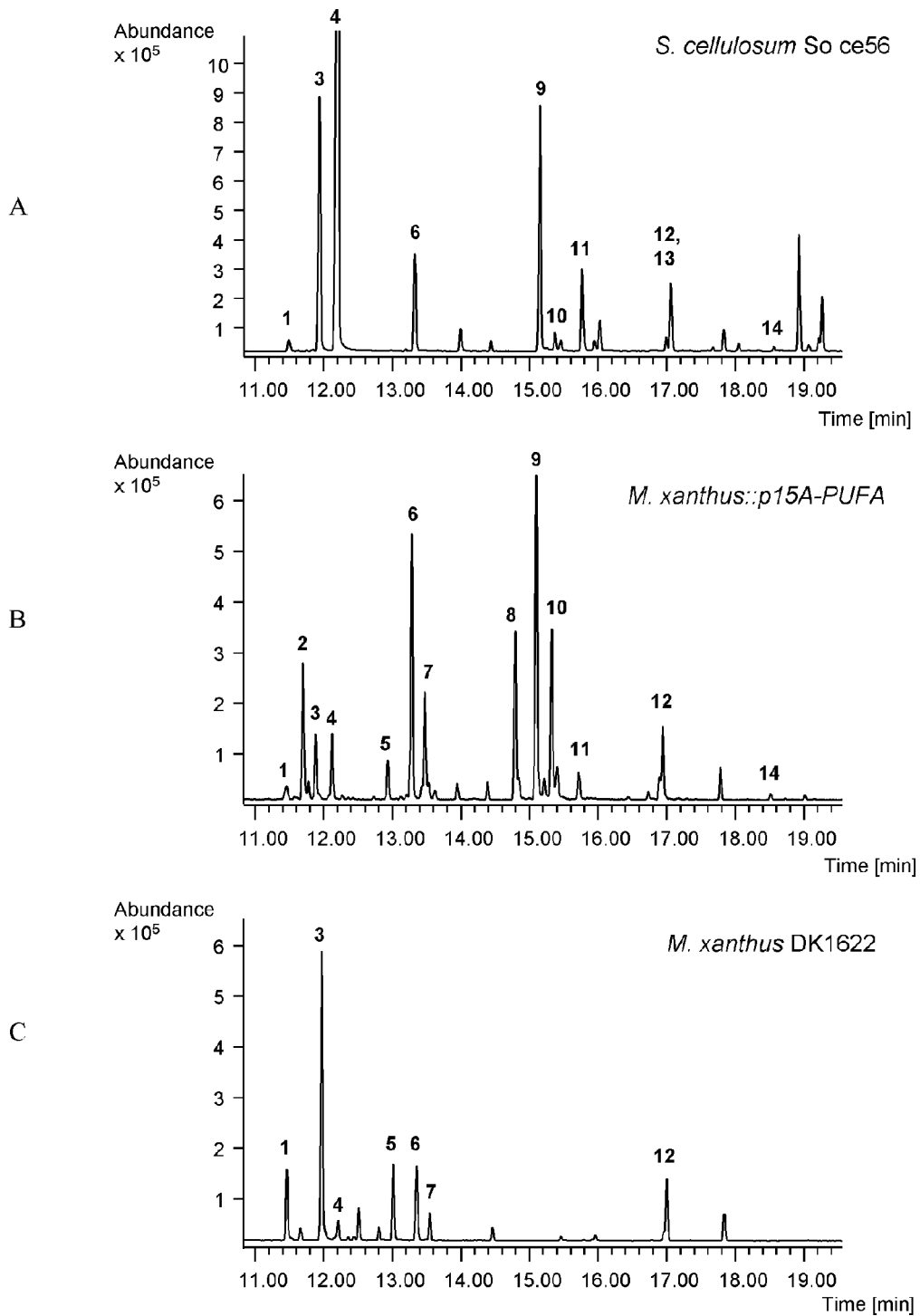
FIG. 3A shows a gas chromatography (GC) chromatogram of cellular fatty acid extracts from *S. cellulosum* So ce56 wildtype.
FIG. 3B shows a gas chromatography (GC) chromatogram of cellular fatty acid extracts from *M. xanthus*::p15A-PUFA harbouring the expression construct shown in FIG. 2.
FIG. 3C shows a gas chromatography (GC) chromatogram of cellular fatty acid extracts from *M. xanthus* DK1622 wildtype.

FIG. 3 shows the analytical result of PUFA production by *M. xanthus* containing the gene cluster pfa1, pfa2, pfa3 of Soce56 (SEQ ID NO: 1) from a nucleic acid construct according to FIG. 2.

Figure 4:
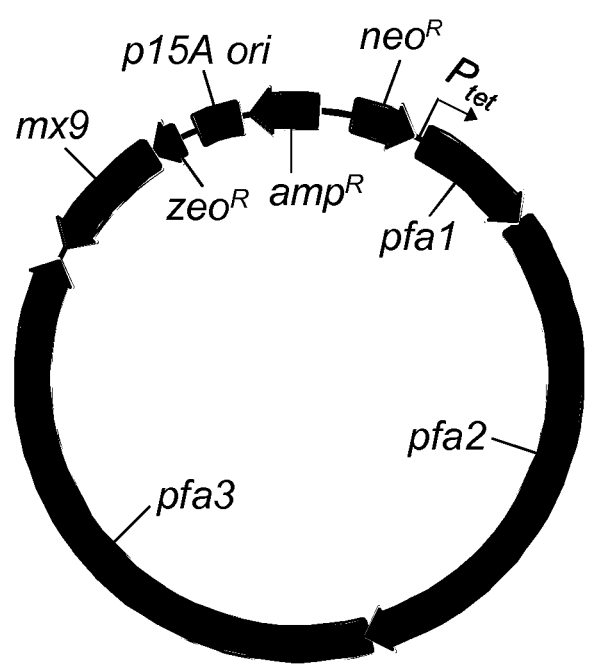
FIG. 4 shows a nucleic acid construct for the heterologous expression of the PUFA biosynthetic gene cluster from *Aetherobacter fasciculatus* DSM 21835 in another myxobacterium e.g. *Myxococcus xanthus* DK1622. PUFA biosynthetic genes (pfa1, pfa2 and pfa3) are under control of the $P_{tet}$ promoter, the construct is integrated into the host chromosome via Mx9 attB sites. mx9: gene encoding the Mx9 integrase and containing the Mx9 phage attachment site (attP), $zeo^R$: zeocin resistance gene, $amp^R$: ampicillin resistance gene, p15A ori: p15A origin of replication, $neo^R$: kanamycin resistance gene, $P_{tet}$: tetracycline inducible promoter.

As a further example for production of PUFAs using a producer microorganism that is genetically manipulated to contain the gene cluster encoding Pfa1, Pfa2 and Pfa3 for heterologous expression, *M. xanthus* was transformed with a nucleic acid construct as shown in FIG. 4, which contained the pfa1, pfa2, pfa3 cloned from *Aetherobacter* SBSr002 (SEQ ID NO: 63, or alternatively, SEQ ID NO: 67, SEQ ID NO: 69 and SEQ ID NO: 71). In detail, genomic DNA of DSM 21835 was digested with ScaI cutting in the flanking regions of the PUFA biosynthetic gene cluster revealing a mixture of genomic DNA fragments. A cassette containing a p15A origin of replication as well as an ampicillin resistance gene (p15A ori-amp$^R$ from pACYC177) was amplified by PCR and homology arms to both ends of the genomic DNA fragment harboring the PUFA biosynthetic gene cluster were introduced with the primer sequence. In addition, an unique PadI restriction site for later subcloning of transfer cassettes was introduced together with the homology arm of the 3' end of the gene cluster. The genomic DNA fragment harboring the PUFA biosynthetic gene cluster was then subcloned into the PCR product by in vivo double homologous recombination. The recombinant construct was further modified by a second double homologous recombination step to integrate a kanamycin resistance gene as well as a $P_{tet}$ promoter amplified by PCR and flanked by two homology arms at the 5' end of the PUFA biosynthetic gene cluster. The construct was then further engineered by conventional cloning methods: The zeo$^R$-mx9 cassette containing a zeocin resistance gene and a gene encoding the Mx9 integrase with corresponding phage attachment sites (attP) for the integration in the host chromosome was introduced via the unique PadI restriction site at the 3' end of the PUFA biosynthetic gene cluster. The PUFA expression construct is then transformed into *M. xanthus* DK1622. The transformants were genotypically and phenotypically analyzed. *M. xanthus* transformants harboring the PUFA biosynthetic gene cluster were grown in CTT medium supplemented with 60 µg/mL kanamycin and 20 µg/mL zeocin at 30° C. for 2-3 days. The culture was centrifuged and PUFAs extracted, esterified and analysed by GC-MS.

As a further example for production of PUFA by cultivating a production organism in a process of the invention, a 10 L stirred bioreactor (Biostat E, Braun Melsungen) was used to cultivate the *M. xanthus* strain harbouring the PUFA gene cluster of Soce56, and separately *M. xanthus* harbouring the PUFA gene cluster of *Aetherobacter fasciculatus*, each as described herein, in the appropriate medium at 2 L/min aeration, agitation at 120 rpm at 28° C. for 5 to 7 days. For inoculation, 72 h shake-flask pre-cultures were used. The analyses of methylated PUFA showed 0.4 to 1.6% γ-linolenic acid for each strain and 0.6% DHA for the *M. xanthus* expressing the *A. fasciculatus* gene cluster in dried biomass.

EXAMPLE 7

Sequence Comparison

Catalytic domains within the novel myxobacterial PUFA synthases were annotated using various bioinformatic tools as listed in the following section, wherein ER=enoyl reductase, KS=β-ketoacyl synthase, MAT=malonyl/acetyl transferase, ACP=acyl carrier protein, KR=β-ketoacyl reductase, DH=β-hydroxyacyl dehydratase:

Pfa1_ER domain was annotated by alignments with the corresponding sequences of *Shewanella* sp. SCRC-2738, *Moritella marina* MP-1, *Photobacterium profundum* SS9, and *Schizochytrium* sp. ATCC_20888.

Pfa2_KS-MAT-ACPs-KR were annotated with Jacques Ravel's PKS/NRPS Analysis Web-site (see Internet at nrps.igs.umaryland.edu/nrps).

Pfa2_DH was annotated by alignments with the corresponding sequences of *Shewanella* sp. SCRC-2738, *Moritella marina* MP-1, *Photobacterium profundum* SS9, and *Schizochytrium* sp. ATCC_20888.

Pfa3_KS-CLF-DH-DH were annotated with the Pfam Sequence Search (see Internet at pfam.sanger.ac.uk).

Pfa3_AT was annotated by alignments with the corresponding sequences of *Shewanella* sp. SCRC-2738, *Moritella marina* MP-1, *Photobacterium profundum* SS9, and *Schizochytrium* sp. ATCC_20888. In a BlastP (National Cancer Institute, USA: see Internet at blast.ncbi.nlm.nih.gov/Blast.cgi?PAGE=Proteins) and Pfam Sequence Search (Version 24.0; The Wellcome Trust Sanger Institute, Cambridge, UK: see Internet at pfam.sanger.ac.uk) the most significant hit represents an AT domain, but it may be that it serves another function. Additional currently not identified domains may be encoded in the genes described herein.

In addition to the organisational differences between the gene clusters, comparable functional regions in the myxobacterial gene clusters as defined in FIG. 1 show an unexpectedly low level of sequence identity on the protein as well as on the DNA level to known PUFA biosynthetic genes (table 1) as shown in tables 2 and 3. Sequence similarity among the myxobacterial PUFA genes of the invention is overall higher (see table 4).

TABLE 1

Comparative known biosynthetic gene clusters encoding PUFA-synthases

| Strain | GenBank accession no. | Product | Reference |
|---|---|---|---|
| *Shewanella sp.* SCRC-2738 | U73935.1 | EPA/DPA | Metz, Science 2001, 293: 290-293; Takeyama, Microbiol. 1997, 143: 2725-2731 |

TABLE 1-continued

Comparative known biosynthetic gene clusters encoding PUFA-synthases

| Strain | GenBank accession no. | Product | Reference |
|---|---|---|---|
| Moritella marina MP-1 ATCC_15381 | AB025342.2 | DHA | Tanaka, Biochem. Soc. Trans. 2000, 28: 943-945; Morita, Biotechnol. Lett. 1999, 21: 641-646 |
| Photobacterium profundum SS9 | AF409100.1 | EPA | Allen, Microbiol. 2002, 148: 1903-1913 |
| Schizochytrium sp. ATCC_20888 | AF378327.2 AF378328.2 AF378329.2 | DHA/ DPA | Metz, Science 2001 |

BLAST accession number of *Sorangium cellulosum* Soce56: YP001611457.1

The following sequence comparison of the myxobacterial domain IV* (AGPAT) sequences from the PUFA gene cluster of *Sorangium cellulosum* So ce56 (=So ce56) and AGPAT of *Aetherobacter fasciculatus* DSM 21835 (=*A. fasciculatus*) with the corresponding sequences of the comparative microorganisms *Methylibium petroleiphilum* PM1 (1$^{st}$ line of each box) *Clostridium* sp. 7_2_43FAA (2$^{nd}$ line of each box), *Talaromyces stipitatus* ATCC 10500 (3$^{rd}$ line of each box), and *Pseudomonas putida* GB-1 (4$^{th}$ line of each box) each show important sequence differences, both on the DNA and protein level.

TABLE 2

Sequence comparison of domain IV* with known domains
Upper block: So ce56 vs. comparative microorganisms
Lower block: *A. fasciculatus* vs. comparative microorganisms

| Type | tool | Domain IV* |
|---|---|---|
| DNA pairwise identity [%] | Geneious | 55.1 |
| | | 15.8 |
| | | 49.4 |
| | | 53.7 |
| | ClustalW | 50.2 |
| | | 35.4 |
| | | 43.4 |
| | | 47.6 |

TABLE 2-continued

Sequence comparison of domain IV* with known domains
Upper block: So ce56 vs. comparative microorganisms
Lower block: *A. fasciculatus* vs. comparative microorganisms

| | | |
|---|---|---|
| protein identity [%] | ClustalW | 9 |
| | | 8 |
| | | 8 |
| | | 8 |
| protein similarity [%] | ClustalW | 14 |
| | | 15 |
| | | 16 |
| | | 13 |

| type | tool | Domain IV* |
|---|---|---|
| DNA pairwise identity [%] | Geneious | 53.2 |
| | | 57.1 |
| | | 48.5 |
| | | 52.0 |
| | ClustalW | 49.5 |
| | | 33.2 |
| | | 39.4 |
| | | 47.7 |
| protein identity [%] | ClustalW | 14 |
| | | 12 |
| | | 16 |
| | | 17 |
| protein similarity [%] | ClustalW | 23 |
| | | 22 |
| | | 28 |
| | | 26 |

The rather low identities and similarities of the domain IV* of *Sorangium* and *Aetherobacter* to the functionally similar domains of known organisms show that the synthetic genes used in the invention significantly differ from the previously known genes.

Comparison Of Myxobacterial PUFA Gene Domains and Protein Domains with Comparative Bacterial PUFA Genes/Proteins The sequence comparison of table 3 of the domains of PUFA genes of the invention with homologous domains of known microorganisms shows important sequence differences between the genes of the invention and the known genes, both on the DNA and protein level.

TABLE 3

Sequence comparison to comparative genes

| | | Regions of the PUFA cluster‡ | | | | | | |
|---|---|---|---|---|---|---|---|---|
| type | tool | I | IIa | IIb | IIc | IIIa | IIIb | IV* vs. IV |
| DNA pairwise identity [%] | Geneious | 53.6 | 50.2 | 55.2 | 48.1 | 47.0 | 50.3 | 46.8 |
| | | 53.5 | 50.0 | 50.9 | 46.3 | 44.6 | 46.7 | 45.0 |
| | | 52.4 | 51.1 | 53.7 | 47.2 | 46.5 | 49.5 | 45.8 |
| | ClustalW | 51.8 | 46.6 | 53.0 | 434 | 42.8 | 45.9 | 40.1 |
| | | 50.1 | 45.9 | 49.4 | 41.8 | 40.4 | 41.5 | 37.8 |
| | | 50.3 | 47.1 | 50.3 | 43.1 | 42.2 | 42.6 | 37.6 |
| protein identity [%] | ClustalW | 45 | 37 | 41 | 21 | 23 | 31 | 9 |
| | | 44 | 35 | 39 | 26 | 22 | 28 | 11 |
| | | 44 | 36 | 41 | 25 | 24 | 31 | 12 |
| protein similarity [%] | ClustalW | 65 | 51 | 56 | 34 | 36 | 44 | 23 |
| | | 63 | 51 | 56 | 40 | 35 | 42 | 25 |
| | | 64 | 51 | 56 | 38 | 38 | 44 | 26 |

| type | tool | I | IIa | IIb | IIc | IIIa | IIIb | IV | IV* vs. IV |
|---|---|---|---|---|---|---|---|---|---|
| DNA pairwise identity | Geneious | 53.1 | 50.2 | 58.6 | 48.5 | 47.6 | 49.4 | 48.2 | 46.8 |
| | | 51.8 | 49.9 | 54.8 | 46.9 | 45.8 | 47.2 | 45.4 | 46.7 |

TABLE 3-continued

| Sequence comparison to comparative genes | | | | | | | | | |
|---|---|---|---|---|---|---|---|---|---|
| [%] | | 53.6 | 50.9 | 57.5 | 47.2 | 46.4 | 49.1 | 47.6 | 45.9 |
| | ClustalW | 50.5 | 46.0 | 54.6 | 42.9 | 43.9 | 45.3 | 43.4 | 40.4 |
| | | 49.1 | 47.2 | 52.5 | 40.9 | 42.0 | 41.7 | 39.7 | 38.5 |
| | | 51.7 | 47.3 | 54.3 | 42.1 | 42.3 | 45.0 | 40.9 | 39.9 |
| protein identity | ClustalW | 45 | 36 | 26 | 22 | 24 | 23 | 8 | 8 |
| [%] | | 44 | 36 | 30 | 24 | 23 | 23 | 8 | 8 |
| | | 44 | 37 | 29 | 24 | 25 | 22 | 9 | 9 |
| protein similarity | ClustalW | 64 | 50 | 34 | 35 | 38 | 36 | 16 | 16 |
| [%] | | 63 | 50 | 41 | 38 | 37 | 36 | 14 | 15 |
| | | 63 | 51 | 37 | 36 | 39 | 35 | 16 | 18 |

Upper block: So ce56 compared to PUFA genes of *Shewanella* (1st line of each box), *Moritella marina* (2nd line of each box), *Photobacterium profundum* (3rd line of each box)

Lower block: *A. fasciculatus* compared to PUFA genes of *Shewanella* (1st line of each box), *Moritella marina* (2nd line of each box), *Photobacterium profundum* (3rd line of each box)

† The alignments were performed with the GENEIOUS program as specified herein.

‡ Definition of the Aligned Regions:

Generally, the domains of the gene cluster from Soce and Aetherobacter (SBSr002) are as described in the short description of the sequence listing.

Domain I (DNA sequence comparison): Complete gene sequence of pfa1 from Soce56 and pfa1 from *A. fasciculatus* (SBSr002) were aligned against complete gene sequences of pfaD (=Orf8) from *Shewanella* sp. SCRC-2738 (Acc.-No.: U73935.1/30730-32361 nt), orfl1 from *Moritella marina* MP-1 (Acc.-No.: AB025342.2/27119-28735 nt) and pfaD from *Photobacterium profundum* SS9 (Acc.-No.: AF409100.1/23166-24800 nt).

Domain I (protein sequence comparison): Complete protein sequences of Pfa1 from Soce56 or Pfa1 from *A. fasciculatus* were aligned against complete protein sequences of PfaD (=orf8) from *Shewanella* sp. SCRC-2738 (Acc.-No.: AAB81126.1/1-543 aa), Orfl1 from *Moritella marina* MP-1 (Acc.-No.: BAA89385.1/1-538 aa) and PfaD from *Photobacterium profundum* SS9 (Acc.-No.: AAL01063.1/1-544 aa).

Domain IIa (DNA sequence comparison): The gene pfa2 from Soce56 and gene pfa2 from *A. fasciculatus* were aligned to the gene pfaA (=Orf5) from *Shewanella* sp. SCRC-2738 (Acc.-No.: U73935.1), to the gene orf8 from *Moritella marina* MP-1 (Acc.-No.: AB025342.2) and to the gene pfaA from *Photobacterium profundum* SS9 (Acc.-No.: AF409100.1).

Domain IIa (protein sequence comparison): The protein Pfa2 from So ce56 and protein Pfa2 from *A. fasciculatus* were aligned against protein PfaA (=Orf5) from *Shewanella* sp. SCRC-2738 (Acc.-No.: AAB81123.1), the N-terminus of the protein Orf8 from *Moritella marina* MP-1 (Acc.-No.: BAA89382.2) and the N-terminus of the protein PfaA from *Photobacterium profundum* SS9 (Acc.-No.: AAL01060.1).

Domain IIb (DNA sequence comparison): The gene pfa2 from So ce56 was aligned against the center section of the gene pfaA (=Orf5) from *Shewanella* sp. SCRC-2738 (Acc.-No.: U73935.1), gene orf8 from *Moritella marina* MP-1 (Acc.-No.: AB025342.2) gene pfaA from *Photobacterium profundum* SS9 (Acc.-No.: AF409100.1).

Domain IIb (protein sequence comparison): Protein Pfa2 from So ce56 was aligned against the center section of the protein PfaA (=Orf5) from *Shewanella* sp. SCRC-2738 (Acc.-No.: AAB81123.1/1244-1747 aa), the center section of the protein Orf8 from *Moritella marina* MP-1 (Acc.-No.: BAA89382.2/1251-1734 aa) and the center section of the protein PfaA from *Photobacterium profundum* SS9 (Acc.-No.: AAL01060.1/1227-1700 aa).

Domain IIc (DNA sequence comparison): The gene pfa2 from So ce56 and the gene pfa2 from *A. fasciculatus* were aligned against the 3' end of the gene pfaA (=Orf5) from *Shewanella* sp. SCRC-2738 (Acc.-No.: U73935.1/19147-22176 nt), the 3' end of the gene orf8 from *Moritella marina* MP-1 (Acc.-No.: AB025342.2/15213-17969 nt) and the 3' end of the gene pfaA from *Photobacterium profundum* SS9 (Acc.-No.: AF409100.1/12554-15175 nt).

Domain IIc (protein sequence comparison): The protein Pfa2 from So and protein Pfa2 from *A. fasciculatus* were aligned against the C-terminus of the protein PfaA (=Orf5) from *Shewanella* sp. SCRC-2738 (Acc.-No.: AAB81123.1/1748-2756 aa), the C-terminus of the protein Orf8 from *Moritella marina* MP-1 (Acc.-No.: BAA89382.2/1735-2652 aa) and the C-terminus of the protein PfaA from *Photobacterium profundum* SS9 (Acc.-No.: AAL01060.1/1701-2573 aa).

Domain IIIa (DNA sequence comparison): The gene pfa3 from So ce56 and the 5' end of the gene pfa3 from *A. fasciculatus* were aligned against the 5' end of the gene pfaC (=Orf7) from *Shewanella* sp. SCRC-2738 (Acc.-No.: U73935.1/24518-27868 nt), the 5' end of the gene orf10 from *Moritella marina* MP-1 (Acc.-No.: AB025342.2/20847-24044 nt) and the 5' end of the gene pfaC from *Photobacterium profundum* SS9 (Acc.-No.: AF409100.1/17271-20528 nt).

Domain IIIa (protein sequence comparison): The protein Pfa3 from So ce56 and the protein Pfa3 from *A. fasciculatus* were aligned against the N-terminus of the protein PfaC (=Orf7) from *Shewanella* sp. SCRC-2738 (Acc.-No.: AAB81125.1/1-1117 aa), the N-terminus of the protein Orf10 from *Moritella marina* MP-1 (Acc.-No.: BAA89384.1/1-1066 aa) and the N-terminus of the protein PfaC from *Photobacterium profundum* SS9 (Acc.-No.: AAL01062.1/1-1086 aa).

Domain IIIb (DNA sequence comparison): The gene pfa3 from Soce56 and the gene pfa3 from *A. fasciculatus* were aligned against the 3' end of the gene pfaC (=Orf7) from *Shewanella* sp. SCRC-2738 (Acc.-No.: U73935.1/27869-30532 nt), the 3' end of the gene orf10 from *Moritella marina* MP-1 (Acc.-No.: AB025342.2/24045-26882 nt) and the 3' end of the gene pfaC from *Photobacterium profundum* SS9 (Acc.-No.: AF409100.1/20529-23147 nt).

Domain IIIb (protein sequence comparison): The protein Pfa3 from So ce56 and the center section of the protein Pfa3 from *A. fasciculatus* were aligned against the C-terminus of the protein PfaC (=Orf7) from *Shewanella* sp. SCRC-2738 (Acc.-No.: AAB81125.1/1118-2004 aa), the C-terminus of the protein Orf10 from *Moritella marina* MP-1 (Acc.-No.: BAA89384.1/1067-2011 aa) and the C-terminus of the protein PfaC from *Photobacterium profundum* SS9 (Acc.-No.: AAL01062.1/1087-1958 aa).

Domain IV* (DNA sequence comparison): The pfa3 from Soce56 and the 3' end of the gene pfa3 from *A. fasciculatus* were aligned against the complete gene sequences of pfaB (=Orf6) from *Shewanella* sp. SCRC-2738 (Acc.-No.: U73935.1/22176-24518 nt), orf9 from *Moritella marina* MP-1 (Acc.-No.: AB025342.2/18126-20723 nt) and pfaB from *Photobacterium profundum* SS9 (Acc.-No.: AF409100.1/15175-17274 nt).

Domain IV* (protein sequence comparison): The protein Pfa3 from Soce56 and the protein Pfa3 from *A. fasciculatus* were aligned against the complete protein sequences of PfaB (=orf6) from *Shewanella* sp. SCRC-2738 (Acc.-No.: AAB81124.1/1-780 aa), of Orf9 from *Moritella marina* MP-1 (Acc.-No.: BAA89383.1/1-865 aa) and PfaB from *Photobacterium profundum* SS9 (Acc.-No.: AAL01061.1/1-699 aa).

FIG. 1 shows the above defined regions I, IIa, IIb, IIc, IIIa, IV if applicable, IIIb and IV*.

Again, the sequence comparison of domains of PUFA genes from Soce56 and Aetherobacter to those of *Schizochytrium* shows the very low sequence homology of the genes of the invention to known genes of PUFA synthesis.

Domain IIa (protein sequence comparison): N-terminal section of the protein OrfA (=SubunitA) from *Schizochytrium* sp. ATCC__20888 (Acc.-No.: AAK72879.2/1-1233 aa).

Domain IIb (DNA sequence comparison): Gene orfA (=subunitA) from *Schizochytrium* sp. ATCC__20888 (Acc.-No.: AF378327.2/3700-6198 nt).

Domain IIb (protein sequence comparison): Protein OrfA (=SubunitA) from *Schizochytrium* sp. ATCC__20888 (Acc.-No.: AAK72879.2/1234-2066 aa).

Domain IIc (DNA sequence comparison): 3' end of the gene orfA (=subunitA) from *Schizochytrium* sp. ATCC__20888 (Acc.-No.: AF378327.2/6199-8733 nt).

Domain IIc (protein sequence comparison): C-terminal section of the protein OrfA (=subunitA) from *Schizochytrium* sp. ATCC__20888 (Acc.-No.: AAK72879.2/2067-2910 aa).

Domain IIIa (DNA sequence comparison): 5' end of the gene orfB (=subunitB) from *Schizochytrium* sp. ATCC__20888 (Acc.-No.: AF378328.2/1-3150 nt).

Domain IIIa (protein sequence comparison): N-terminal section of the protein OrfB (=subunitB) from *Schizochytrium* sp. ATCC__20888 (Acc.-No.: AAK72880.2/1-1050 aa).

Domain IIIb (DNA sequence comparison): 5' end of the gene orfC (=subunitC) from *Schizochytrium* sp. ATCC__20888 (Acc.-No.: AF378329.2/1-2847 nt).

TABLE 4

Sequence comparison of myxobacterial PUFA genes/proteins with PUFA genes/proteins from *Schizochytrium* sp.
upper block: Soce56 vs. *Schizochytrium* sp.
lower block: *A. fasciculatus* vs. *Schizochytrium* sp.*

| | | domain of the PUFA cluster‡ | | | | | | | |
|---|---|---|---|---|---|---|---|---|---|
| Type | tool | Ia | Ib | IIa | IIb | IIc | IIIa | IIIb | IV* vs. IV |
| DNA pairwise identity [%] | Geneious | 59.2 | 61.4 | 55.6 | 60.9 | 56.7 | 52.9 | 54.1 | 51.0 |
| | ClustalW | 55.8 | 58.8 | 51.5 | 57.4 | 52.6 | 48.5 | 50.0 | 43.3 |
| protein Identity [%] | ClustalW | 37 | 38 | 30 | 32 | 26 | 22 | 26 | 10 |
| protein similarity [%] | ClustalW | 57 | 57 | 44 | 42 | 39 | 34 | 38 | 20 |

| type | tool | Ia | Ib | IIa | IIb | IIc | IIIa | IIIb | IV | IV* vs. IV |
|---|---|---|---|---|---|---|---|---|---|---|
| DNA pairwise identity [%] | Geneious | 58.3 | 61.3 | 55.9 | 62.8 | 56.7 | 52.8 | 54.9 | 53.2 | 51.1 |
| | ClustalW | 55.6 | 59.0 | 52.2 | 61.7 | 51.9 | 49.7 | 49.3 | 50.1 | 45.5 |
| protein Identity [%] | ClustalW | 40 | 41 | 29 | 15 | 26 | 23 | 21 | 16 | 11 |
| protein Similarity [%] | ClustalW | 57 | 58 | 43 | 21 | 42 | 35 | 31 | 26 | 22 |

‡Defination of the aligned domains: The domains of the gene cluster from Soce56 and *Aetherobacter* (SBSr002) are as described in the short description of the sequence listing.

The comparative domains of *Schizochytrium* were:

Domain Ia (DNA sequence comparison): 3' end of the gene orfB (=subunitB) from *Schizochytrium* sp. ATCC__20888 (Acc.-No.: AF378328.2/4500-6180 nt).

Domain Ia (protein sequence comparison): C-terminus of the protein OrfB (=subunitB) from *Schizochytrium* sp. ATCC__20888 (Acc.-No.: AAK72880.2/1500-2059 aa).

Domain Ib (DNA sequence comparison): 3' end of the gene orfC (=subunitC) from *Schizochytrium* sp. ATCC__20888 (Acc.-No.: AF378329.2/2848-4509 nt).

Domain Ib (protein sequence comparison): C-terminus of the protein OrfC (=SubunitC) from *Schizochytrium* sp. ATCC__20888 (Acc.-No.: AAK72881.2/950-1502 aa).

Domain IIa (DNA sequence comparison): 5' end of the gene orfA (=subunitA) from *Schizochytrium* sp. ATCC__20888 (Acc.-No.: AF378327.2/1-3699 nt).

Domain IIIb (protein sequence comparison): N-terminal section of the protein OrfC (=subunitC) from *Schizochytrium* sp. ATCC__20888 (Acc.-No.: AAK72881.2/1-949 aa).

Domain IV (DNA sequence comparison): The central region of the gene orfB (=subunitB) from *Schizochytrium* sp. ATCC__20888 (Acc.-No.: AF378328.2/3151-4497 nt) was compared to domain IV* of *Sorangium*, and to domains IV and IV* of Aetherobacter, respectively.

Domain IV (protein sequence comparison): Central region of the protein OrfB (=subunitB) from *Schizochytrium* sp. ATCC__20888 (Acc.-No.: AAK72880.2/1051-1499 aa) was compared to domain IV* of *Sorangium*, and to domains IV and IV* of Aetherobacter, respectively.

A sequence comparison between the PUFA genes on DNA and protein level show significant sequence homologies between the domains, genes, and gene clusters of the invention, especially within the group of the domains, genes, and gene clusters of Sorangium, and within the group of the domains, genes, and gene clusters of Aetherobacter, respectively.

Table 5 below shows the result of the sequence comparison for domains of Aetherobacter SBSr002 and SBSr008 (upper block), for domains of Aetherobacter SBSr002 and SBSr003 (middle block), and for domains of Aetherobacter SBSr008 and SBSr003 (lower block).

Table 6 below shows the result of the sequence comparison for domains of Sorangium, Soce56 and Soce377.

The domains used in these comparisons are those described in the sequence listing.

respectively, in combination with a significant degree of sequence identity found between Sorangium and Aetherobacter, especially in respect of domain IV*.

Further, the domains of the PUFA synthetic gene cluster of Sorangium and Aetherobacter have a high protein identity and similarity as shown in table 7 below, which is e.g. significantly higher than the protein identity and similarity, respectively, of Sorangium and Aetherobacter towards the relevant regions and domains of known organisms, e.g. towards functionally similar domains of Shewanella, Moritella marina, and Photobacterium profundum as shown in table 3, and towards Schizochytrium as shown in table 4.

TABLE 5

Comparison of myxobacterial PUFA genes/proteins of Aetherobacter

| | | domains of the PUFA clusters | | | | | | | |
|---|---|---|---|---|---|---|---|---|---|
| Type | tool | I | IIa | IIb | IIc | IIIa | IIIb | IV | IV* |
| DNA pairwise identity [%] | Geneious | 99.0 | 97.8 | 95.9 | 96.3 | 98.6 | 96.9 | 98.3 | 96.8 |
| | ClustalW | 99.0 | 97.8 | 95.9 | 96.3 | 98.6 | 96.8 | 98.3 | 96.8 |
| protein identity [%] | ClustalW | 99 | 97 | 99 | 96 | 98 | 96 | 98 | 95 |
| protein similarity [%] | ClustalW | 99 | 98 | 99 | 97 | 98 | 97 | 99 | 98 |
| DNA pairwise identity [%] | Geneious | 92.3 | | | | | | | 85.6 |
| | ClustalW | 92.3 | | | | | | | 85.4 |
| protein identity [%] | ClustalW | 94 | | | | | | | 84 |
| protein similarity [%] | ClustalW | 96 | | | | | | | 88 |
| DNA pairwise identity [%] | Geneious | 92.5 | | | | | | | 85.9 |
| | ClustalW | 92.5 | | | | | | | 85.5 |
| protein identity [%] | ClustalW | 94 | | | | | | | 84 |
| protein similarity [%] | ClustalW | 97 | | | | | | | 89 |

TABLE 6

Comparison of myxobacterial PUFA genes/proteins of Sorangium

| | | domains of the PUFA clusters | | | | | | |
|---|---|---|---|---|---|---|---|---|
| type | tool | I | IIa | IIb | IIc | IIIa | IIIb | IV* |
| DNA pairwise identity [%] | Geneious | 98.2 | 95.8 | 91.1 | 97.8 | 96.1 | 97.0 | 96.9 |
| | ClustalW | 98.2 | 95.8 | 91.1 | 97.8 | 95.9 | 97.0 | 96.9 |
| protein identity [%] | ClustalW | 98 | 94 | 90 | 97 | 94 | 95 | 97 |
| protein similarity [%] | ClustalW | 99 | 96 | 91 | 97 | 95 | 96 | 98 |

These analyses show the significant degrees of identity of the PUFA gene cluster domains for the group of genes of Sorangium and for the group of genes of Aetherobacter,

TABLE 7

Comparison of myxobacterial PUFA genes/proteins of Sorangium and Aetherobacter

| | | domains of the PUFA clusters | | | | | | |
|---|---|---|---|---|---|---|---|---|
| type | tool | I | IIa | IIb | IIc | IIIa | IIIb | IV* |
| DNA pairwise identity [%] | Geneious | 70.4 | 69.8 | 67.5 | 65.9 | 65.3 | 69.0 | 63.5 |
| | ClustalW | 69.2 | 68.0 | 66.1 | 63.7 | 62.3 | 67.1 | 62.0 |
| protein identity [%] | Geneious | 59 | 58 | 27 | 47 | 46 | 42 | 22 |
| | ClustalW | 59 | 57 | 26 | 47 | 47 | 42 | 24 |
| protein similarity [%] | Geneious | 73 | 67 | 34 | 61 | 56 | 49 | 29 |
| | ClustalW | 73 | 68 | 33 | 60 | 56 | 50 | 31 |

Accordingly, PUFA synthetic pathway enzymes of the invention contain a domain having AGPAT activity and an amino acid sequence which is to at least 22%, preferably to at least 24%, more preferably to at least 29% or 31%, most preferably to at least 50%, 85%, 90% or to at least 95% identical to at least one amino acid sequence of a domain IV* of Sorangium and/or of Aetherobacter as described herein.

SEQUENCE LISTING (170 sequences)

SEQ ID NO: 1 - DNA, 17176 bp, Sorangium cellulosum
  source 1..17176: /mol_type="DNA" /organism="Sorangium cellulosum"
  CDS 1..1650: /transl_table=11
  CDS 1677..9389: /codon_start=1 /product="pfa2, SEQ ID NO 3" /transl_table=11
  CDS 9386..17176: /codon_start=1 /product="pfa3, SEQ ID NO 4" /transl_table=11
atgattgaggatccgcaggtcatccgcagcgccggcctccagccgatcggcatctggcgcagcgggccctggctccccgcgttcacatcgacagatttgcgggaggccgtctcctgcgtgcgagagccggtgcacgtggtgcgtgagacgccggaggggcgcgtcggcgtgtcccgcggcggcgctgtcctccgcgaggatcaggtcaacggggtcccgacgttcccgctcctcggaacgctgcccgccctgtacccggagtggctcggagaccgctccttcgtcgaggtccacggcctgcgcttcccgtacgtggccggcgcgatggcgaacggcatccacaccacgcggctcacgatcgcgatggccaaggcaggcatgatggggttcttcggcgccgcaggcctcgggctgcaccggatcgagcaggcgatcgacgagatctcggcggcgctcggcacggacggccccacctggggctgcaacctcatccacgctccgaaccagcccaggctggagagcgacacggtggagctctacctcaagaggggagtccggcgggccgaggcggccgcctacatgggcctgaacccgatggtcgtgcggttcgcctacagcggcgtcaagcgcttgcccgacggccgcgtcgaccggaagaaccacctgttcgcgaagatctcgcgcccggaggtcgccgcgcgcttcctgtcgcccgcgccggccgagatcctcgatacttgcgttcgcaacgggtggctcacccgcgacgaggcggagctcgcgcggagcctcccggtcgccgaggacatcaccgtggaagcggactccggcggtcacaccgacaaccagcccctcgtcgcgctgttcccggtgatcctcggcgtccgcgacgagctcgcggcgaagtacgggtatcaccggccgatccgcgtcggcgccgccggcggcctctccacgccggagtcggtcgccgccgcgttcgcgctcggggcggcgtacgtgctcacgggctcggtcaaccagtcgtgcatcgagtcgggcctgtccgacgagggcaagaagatgctggcccaggccgatctcccggacgtggtgatgacgccggccgccgacatgttcgagctcggcgtgcaggtccaggtgctcaagcgcggcacgatgttcggtgtccgggcgcagcggctctacgacctctacgtcgcccacgactccatcgagtcgctgcccggcgacgtgcgcgcgcgcatcgagagggagctgttccagatgtcgtgcgacgaggtgtgggcgggctgcgagcggttcttcgccgagcgcgacccggccgagctcgagcgcgccgcgcgcgagccgaagcacaagatggcgctgatcttccgctggtatctcggcatgtccagcaagtgggcgatcgccggggacccgaagcgccgcgccgattaccagatctggtgcggcccggccatgggcgcgttcaaccgctgggtcaaggggtcgttcctcgaggacccggcgcgccgcaccgcggtccaggtcgcgcgcaacctgctcgagggcgcggccgtcgtcacgcgcgcgcagcagctccggacgtacggcgtccccgtgccgagcgccgcattccacttcactcctcgcccgctcgcctgagcgcctgaccacctgccgaggtcctcatgcatccttcgtcttcgcgtatcccgcacatcgccgtcgtcggcgtgagcgccatcttccccggctcgctcgatgcgcacggcttctggcgcgatatcctgtccgggacagacctcatcacggatgtcccgagcacccactggcttgtcgaggactactacgatcccgacccgtccgccccggacaagacctatgcgaagcgcggcgcctttctcaaggacgtgccgttcgatccgctcgagtggggcgtcccgccttcgatcgtcccggcgacggacacgacgcagctgctcgcgctgatcgtggcgaagcgggtcctggaggacgcggcgcaggggcagttcgagtcgatgagccgcgagcggatgagcgtgatcctcggcgtcacctccgcgcaggagctgctcgcctcgatggtgagccggatccagcggccggtgtgggcgaaggcgctccgggatctcgggtatccggaggacgaggtgaagcgcgcctgcgacaagatcgcgggcaactacgtgccgtggcaggagtcgagctttccgggcctgctcgggaacgtggtggccggtcgcatcgcgaaccggctcgacctcggcgggacgaactgcgtgaccgacgcggcgtgcgcgtcgtcgctgtcggcgatgtcgatggcgatcaacgagctggcgctcggccagtccgatctcgtgatcgcgggcggctgcgacacgatgaacgacgccttcatgtacatgtgcttcagcaagacgcccgcgctgtcgaagtcgggcgactgccggccgttctccgacaaggccgacggcacgctgctcggcgagggcatcgcgatggtggcgctcaagcggctcgacgacgccgagcgcgacggggaccgggtctacgcggtgatccgcgggatcggctcgtcgtcggacgggcggagcaagagcgtgtacgcgccggtgccggaagggcaggcgaaggcgctccgccggacgtacgccgccgccgggtacggccccgagaccgtggagctgatggaggcgcacggcaccgggacgaaggccggcgacgcggccgagttcgagggcctgcgggcgatgttcgacgagtcggggcgcgaagaccgccagtggtgcgcgctcggcagcgtgaagtcgcagatcggccacaccaaggcggcggccggcgcggccggcctgttcaaggcgatcatggccctgcaccacaaggtgctgccgccgaccatcaaggtcgacaagccgaaccccaagctcgacatagaaaagaccgctttctatctcaatacccaggcgcggccgtggatccggccgggggaccacccgcggcgggcgtcggtgagctcgttcggcttcggcggctcgaacttccacgtggcgctggaggagtacacgggcccggcgccgaaggcgtggcgggtgcgggccttgccggcggagctcttcctcctgtcggcggacacgccggcggcgctcgcggatcgcgcgcgggcgctggcgaaggaggcggaggtgcccgagatcctgcgcttcctggcgcgggagtcggtgctctcgttcgacgcgtcgaggccggcgcggctcgggctgtgcgcgacggacgaggcggatctcaggaagaagctcgagcaggtcgcggcgcacctcgaggcgaggccggagcaggcgctctcggcgccgctcgtgcactgcgcgagcggggaggcgccggggcgggtggcgttcctgttcccggggcaggggagccagtacgtcgggatgggcgcggacgcgctcatgacgttcgacccggcccgcgcggcctgggacgcggcggcgggcgtcgcgatcgcggacgcgccgctgcacgaggtggtgttcccgcggccggtgttctcggacgaggaccgggcggcgcaggaggcgcggctccgcgagacgcggtgggcgcagccggcgatcggcgcgacgagcctcgcgcacctcgcgctgctcgcggcgctcggggtacgggccgaggcgttcgcgggccacagcttcggcgagatcacggcgctgcacgcggccggcgcgctgtccgcggcggacctcctgcgcgtggcgcggcggcgcggcgagctgatgggcgcggcgtcgtcggagcggggcgcgatgatcgcggtcccgcgggggatcgacgaggtgcgggcgctgggcctcggcggggtggtgatcgcgaaccacaacggcccgaagcaggtggtgctgtcgggctcggtcgcggcgatcgaggcggcggaggagcggctgaagggcgccgggatccaggcgcggcgcctcgacgtggccgcggcgttccactcgccgctcgtggcggaggcgagcgcgccgctccgcgagttcctggcgggcatcgcggtcgaggcgccggcggcgcccgtgtacagcaacgcggagatcgagccgtacgcgggcggcggcgacgcggcgcgcgaccggctggcgcggcagctcgcggagccggtgcggtttgtggaggagatcgagcggatgtacgcggacggcgtgcgcacgttcgtcgaggtcgggccgggctcggtgctgacgaacctggtcggcgacatcctgagcggccggccgcaccgggcggtggcgctcgaccgcaagggcaagcacggcgtgacgagcctgctcgaggcggtggcgcggctcgccgtggccggggtgccgctggacgcgcgggtcctctgggaaggcttcgcggcgccgagcgatccgcgggcgctgccgaagccgaagctggcgctgcagatcaacggcagcaactacgggaagccgtacccgccgcaggggggcgcgaaggcgctgccggcggcgagcccgccgcgggcggcgcagaagccggcgccagaggcggcgcgggcggtggtgagcgcgccgcgggcggtggtgagcgcgtcgcagcctgtggtgagcgcgtcggcgcctgtggtgagcgcgccggcgccggcagtgagcgcgtcggcgccggcagtgagcgcgtcgcggccggcagtgagcgcgtcggcgccggcagtgagcgcgtcgacgtctgcggtggcgagcgtgtcggcgcctgtggtgagcacgtcgcggccggcagtgagcgcgtcggcgcctgcggtgagcacgtcgcggccggcagtgagcgcgtcggcgcctgtggtgagcacgtcgcggccggcagtgagcgcgtcgacggctgtggtgagcgcgtcgcggccggcggtgagcgcgtcgtggctggccgcgtaccaggaggcgcagcgcgccacggcggaagcccacagcgtgtaccagcgcacgatggccgagagccacatcgcctttctccaggccgccgaggcgtccttctcagggcttgccgcgctggcgaccggcgctccgtacccggtcgccccgacgacggtgtccgaggtgcggcctgcgccggttctcctcgctccggtgcatgcggggcctgtctcggaggcgtccgtacggcctgcagcggcgccgaccgcgcgctccgagggcaggagcagcgtggccctggacggcctgaacggcgcaggcggggagctccccacgcctgtcgcgctgccggcgcaggcggcgcctgccgtgaccgcgaaggcggcagttgcagcgcccgccgtgacagcaagagcggtcacagcggcgcctgctacggctgtgaaggccgcagccgcggcgccagtggcagtgtccacggccgtcaccgcgcccgcggccgccgtggtaacgcaggcggcggtcgccgctgcgccgcgtgtcgatatcgagcggttggtcctcgacgttgtcgcggacaagacgggataccccgtctccatgctcgggctgcagatggagctggagagcgatctcggcatcgacagcatcaagcgggtggagatcctgtcctcggtccgtgaccggacgcccgggctgtcggaggtcgacgcgtcggcgctggcgcagctgcgcacgctggggcaggtcgtcgaccacctccgcgcctcgctgccggccgccgggccggccgccagcgccagtccggctaccgccgcgcccgcggcgaaggcatccgccgtcgcggcgcctgccgtcgcttctggcgcggcgcctggcgcggccgaggtggagcaggtggtgatggcggtcgtcgcggagacgacgggctacccggcggagatgcttgggctgcagatggagctggagagcgacctcggcatcgacagcatcaagcgggtggagatcctgtcggcggtccgcgaccggacgccggggctgtcggaggtggatgcctcggcgctggcgcagctgcgcacgctggggcaggtcgtcgaccacctccgcgcctcgctgccggccgccagcgccggcccggccgtcgccgcgcccgccgcgaaggctcctgccgtcgcggcgcatgcagtcgcgtccgtcgcggcgcctggcgcggccgaggtggagcgcgtcgtgatggcggtcgtcgcggagacgacgggctacccggcggagatgctggggctgcagatggagctggagagcgacctcggcatcgacagcatcaagcgggtggagatcctgtcggcggtccgcgaccggacgcccgggttgtcggaggtcgacgcgtcggcgctggcgcagctgcgcacgctggggcaggtcgtcgaccacctccgcgcctcgctgccagccgccgggccggccgccagcgccagtccggctgccgccgcgtccgtaccgaaggcctccaccgctgcggtgcctgccgtcgcgtccgtcgcggcgcccggcgcggccgaggtggagcgcgtcgtgatggcggtcgtcgcggagacgacgggctacccggcggagatgctggggctgcagatggagctggagagcgacctcggcatcgacagcatcaagcgggtggagatcctgtcggcggtccgcgaccggacgcccgggttgtcggaggtggatgcctcggcgctggcgcagctgcgcacgctggggcaggtcgtcgaccacctccgcgcctcgctgccggccgccagcgccggcccggccgtcgctgcgcccgccgcgaaggctcctgccgttgcggcgcctaccggcgtgtccggcgcgacgcccggcgcggccgaggtggagcgcgtcgtgatggcggtcgtcgcggagacgacgggctacccggcggagatgctggggctgcagatggagctggagagcgacctcggcatcgacagcatcaagcgggtggagatcctgtcggcggtccgcgatcggacgccggggctggcggaggtcgacgcttcggcgctggcgcagctgcgcacgctggggcaggtcgtcgaccacctccgcgcgagcctcggtcccgccgctgtcaccgccggcgctgccccggcggagcccgccgaggagccggcctccacgcccctcggccggtggacgctcgtcgaggagccggcgcccgccgccggcctcgcgatgcccggcctcttcgacgcaggcaccctcgtgatcaccggccacgacgcgatcggccccgcgctcgtcgcggccctcgcggcgcgcgggatcgccgccgagtacgcccccgccgtgccccgcggcgcgcgcggcgccgtgttcctcggcggcctgcgcgagctggccacggccgacgcggcgctcgccgtccaccgcgaggcgttcctcgctgcccaggcgatcgcggcgaagccggccctcttcgtcacggtccaggacaccggcggcgacttcggcctcgcgggctcggaccgagcctgggtcggcgggctgccgggcctcgtgaagaccgcggcgctggagtggcccgaggcgtcctgccgcgcgatcgacctcgagcgtgccggccggtccgacggcgagctcgcggaggccatcgcctcggagctcctgtccggcggcgtcgagctcgagatcggcctgcgcgcggacggccggcgcaccacgccgcgcagcgtccggcaggacgcgcagcccgggccgctccccctcgggccgtccgacgtggtcgtggcgagcggcggcgcccgcggcgtcaccgcggcgacgctgatcgcgctcgccagggccagccacgcgcggttcgcgctgctcggccgcaccgcgctcgaggacgagccggccgcctgccgcggcgccgacggcgaggccgcgctcaaggcagcgctcgtcaaggcggcgacctccgcgggccagcgggtgaccccggccgagatcggccggagcgtcgcgaagatcctcgcgaaccgcgaggtccgcgcgacgctcgacgcgatccgcgccgccggcggcgaggccctctacgtccctgtcgacgtgaacgacgcgcgggcggtggccgcggcgctcgacggcgtgcgcggcgccctcggccccgtcacggcgatcgtccacggcgccggcgtgctcgccgacaagctcgtcgccgagaagacggtcgagcagttcgagcgcgtgttcagcacgaaggtcgacggcctccgggccctgctcggcgcgacagcgggcgacccgctcaaggcgatcgtcctcttcagctcgatcgccgcgcgcggcggcaacaaggggcagtgcgactacgcgatggcgaacgaggtcctgaacaaggtcgcggccgccgaggcagcccgccgcccgggctgccgggtgaagtcgctcggctgggggccctggcaaggcggcatggtgaacgcggcgctcgaggcccacttcgcgcagctcggcgtgccgctcatcccgctcgccgcgggcgcgaagatgctcctcgacgagctgtgcgacgcctcgggtgatcgcggcgcgcgcgggcaaggcggcgccccgcccggcgcggtcgagctcgtgctcggcgcggagccgaaggcgctcgcggcccaaggccacggcggccgggtcgcgctggccgtccgcgcggaccgcgcgacgcacccctacctcggcgatcacgccatcaacggcgtgcccgtggtgcctgtggtgatcgcgctcgagtggttcgcccgcgccgcgcgcgcgtgccggccggatctcgtcgtgaccgagctccgcgacgtgcgggtcctgcgcgggatcaagctcgcggcgtacgagtccggcggcgaggtgttccgcgtcgactgccgcgaggtgagcaacggccacggcgcggtgctcgcggcggagctgcgcgggccgcagggggcgctgcactacgcggcgaccatccagatgcagcagcccgaagggcgcgtggccccgaagggcccggccgcgccggagctcggcccgtggcccgccggcggcgagctgtacgacggccgcacgctcttccacggccgcgacttccaggtgatccggcggctcgacggcgtgagccgcgacgggatcgcggggacggtcgtgggcctccgcgaggccggctgggtggcccagccgtggaagaccgatccggcggcgctcgacggcgggctgcagctcgcgacgctgtggacgcagcacgtgctcggcggcgcggcgctcccgatgtccgtgggcgcgctgcacaccttcgcggaggggccgtccgacggcccgctgcgcgcggtggtgcgcgggcagatcgtggcccgcgatcgcacgaaggccgacatcgcgttcgttgacgaccgcggctcgctcgtcgcggagctgcgcgacgtgcagtacgtcctgcgccccgacacggcgcgcggccaggcgtgatcgaggccagcgtgttcgagcccatcgcgatcgtcggccgcgggtgcgtcctcccgggcgcgctccaccccgcggccctctgggacaacgtgctcgccggccgggacctcctgtccgccgcgcccgacggccgctggcgcctctcgcgcgagcgcgcgctcgcgcaggaggggccttccgcgcgcggcgcgcgcgacgtgcgcgacgcgaaggaccgcgcgtggagcgaccgcggcggctacgtcaccgggttcgacgagcacttccgccgcgtgctcgcgagcgacccgttcccgcggcggggcgggacgcccgagtcgctgctcgcgctcgacccgctcttccagtgggtgctccacgcgggccgcgaggcgctgcgcgaggcgggccacgagggccggtccgaccgcgcgggcgcggtgctcgggaacctctcgttcccgtcgtcggccatgtcggcgtgggtcgagtcgacgtggctcggcgatctcgccggcgtcccgcgccccgatccgcgcaaccggttcatgtcggggctgcccgcccacctgctggccgacgtgctcggcctcggggccggggcgttcgcgctcgacgccgcgtgcgcgtcgtcgctgtacgcgatcgcgctcgcctgcgagcggctgcaggatcgcgaggccgaccggatgctcgcgggcgcggtgtgccgctcggacgacctcttcatgcacatcgggttctgcgcgctgtcggccatgagccgcaccgggcagagccgcccgttctcgtcggaggccgacggcctggtcccggcggagggcgcggcgttcgttgtcctggagcgcctgtcggacgcggaggccgcgggcaggccgatcctcggcgtgatccgcgggatcggcctgtcgaacgacggccgcggccgcggcctcctggcgccctccgtcgagggccagctgcgcgcgatgcgggccgcgtacgccatggcgggcctcgatccccgcgaggtgtcgctgctcgagtgccacgcgacgggcacgcccctcggcgacgcgaccgagatcgcgaccctcaaggaggtgttcggctcccgcgaggtcccgctcggctcgctcaagtcgaacctcggtcacctcgtcacgacggccggcgcggccgggctcctcaagctgctcggcgccatggcggccggcgtccgcccgccgacgctgcacgccgatccgctgagcgaggcggtggcctcgagccccttccgggtgctgcagcgcgccgagccgtgggaggggcggcggctcgcgggcctgtcggcgttcgggttcggcgggaacaatgcccacctcctcgtggaggcgtacgagccgtcctcgccgaggggccgcgcggcccgcgccgcgccgcaggccgccgcggcggcctcgcgccctgtcgacgccgggcgccccgcgccggcaggccacctggccgtggtggccatgggcctgtgcgtcggtgagctcagcggcgtccgggccttcgcggagccgctcctctcgggccgcggcgcggatccccgccgggcggcggtcgcgctgcccgcggatcggctccggtttccgccgcgcgatctgcagcaggcgctcgcccagcagacgctgctgctcgaggcggcgatcgaggccaccgaggggctcgcgctgccgcgcgatcgcaccgccgtgctgatcggcatgggcgccgacaccgaggtgtgccggtacatgacgcgctggcggctcgccgagacggcgccggcgcggctcggtccgtcggtcgacgtcggcgcgctccaggacgcgatcatccctgcgctgcaggcggcgggcgtcgtcgggaacatgcccaacatcccggcgaaccggctgaacagccagctcgacgtcggtggaccgtcgttcacgatcgcggccgaggagctgtccggcccctgggcgctgcgcgtcgcgtcccgcgccctgcgcgccggcgcggtggacgcggcgatcgtcggcgcggtggatctctcgtgcgagcccgcccacgcggctgcgctcgaggcgctcggcgtccgcctgccccccggcgacgccgccgtggtgctcgtgctcgagcgcctcgacgacgccgtccgggagcggcacccggtcctggccgttgtcgtggacgagccggccgaccctggcctcgtgctgtcgtccacggatctcgcgccgcggttcggccacgcgcacgcggcctcgggcctgctgcacgtggccgccgcggtgctcgcctgccgtcacggccgcaagcccgacggggcgccgtggtccgacgagatccgggtcgccgaggtccgctgcgccggcctcggcggcggctcgctgtcggtccgcatcggggccggcggccccgccgcgccgctcccgccgccgcgatcggcggaggggccgacgctgacgctccccgcccacccgccggcgatcgtcgtgcccggcgcggcctcctgttcatcccccggagactccatggaacctgcgccgcctctgccgtccgctctcgacgacctgccgccgctgtaccccgggcccacggggttctctgccgccgacgcggatcgggcgccgtcctgggacgagccgccgccggtcgggccggcggtcgtcacggccgtcgccgcgagcctcgcagaggagccgccgccggtcggaccggccgtcgtcgcggccgctgccgtggacatcccgggcgacgtgatcgccggcgccgcggcgttcaccgtgcagctggcgcagatccacaaggagtgggcggagcagcaggcccaggtccaccgccggttccttcagatgcggcagcgcgcgctggactcgctcgtgcaggcgtcgtcgggcgcggccgcggtggtggtcgagacccccttggcgcaggtgccccacgccgcgccggtccgtatcgaggggccgcgcctggtcgatgcgccgcgcctggtcgatgcgccgccgctcgcccgcgccgaggcgccgcagctcgctcgcgccgagtcgccgcgtgtcgttgaaccgccgcgcgtcgtcgaggccccgcgcccctccgccgcgccgccccctgcgccgcgtccctccgcccagccggtgctctccgcggcgccttccgtcgcgccccgcggcccccggttcagccgcgagcagctcgagcacctcgcctcggggcggatctccgacgtgttcggcccgctcttcgcccggcaggacgcctatcgccgccaggtgcgcatgcccatgccgccgctgctgctcgccgatcgggtcaccgggatcgacgccgagcccggctcgatgaagctcggcacgatgtggaccgagaccgacgtgcggtgggattcctggtacctgcacgacggcgcgatgccggccggcgtcatgatcgagagcggccaggccgacctgctgctcatcagctggctcggcgcggacttcgagaacaagggcgagcgcgtctaccgcctgctcggctgcgagctcaccttctacggcggcctgccgcgcccgggcgacacgctcgtctacgacatccacgtcgacgggcacgcgaagcacggcgacgtccgcctgttcttcttccactacgactgccggatcggcggcgagctgcgcctgaagacgcgcaagggccaggccggcttcttcaccgacgaggagctcgcgagctccggcggcgtgctctgggacgcggacaccgccgagcccgcgacgaccgcccgcctcgatccgccccggatcgcgtgcgggaagtccgcgttcgaccgggccgacctcctcgcgttcgcggccggagacggcgcggcggcgttcggccccggcttcgatcgtctgagcacccacgtcaggacgccgcggatcagcgctccgcccatgctgttcttcgatcgcgtcgacgtgttcgacccggcgggcggcccgtggaagcgcggctatctccgggccacgctgccgatcacgaaggacggctggtacttcgagggccacttcaaggacgacccctgcatgccggggacgctcatgttcgagggctgcctgcaggcgctcgcgttctacatggcggccatgggcttcacggtggacgcggacggcttccgcttcgagcccgtgccggagatcccgtacctgctccgctgccgcggccaggtggtcccggcgagccgcgtgctcacgtacgaggtgttcgtcgaggaggtccacgacggcccgtgcccgacggtgttcgccgacttcctgtgcacggtcgacggcctcaaggcgttccacgcccgccgcgtgggcctgcgcctcagccccgactggccgctgacgagcgcccccgagctgctcgacggccacgtcgagccggtgccggtcgcgcgcgtcccctggtccgagacgggcgcgccgccgccggacggcgcctctgcagacgccggcggcttcccgttcgattaccggagcctgctctcgtgcgcctggggcaggccgtcggacgcgttcggcccgctctaccgcaggttcgacgggggccagcacgtcgcccggctcccggggccgccgtaccacttcatgagccgggtcctgtcggtctcgcgccccatggcggcgatgaaggccggcgccgaggtcgaggtcgagtacgacgtcccggaggacgcgtggtacttcgacgagaacgcgagcctcacgatgccgttcgcggtggtgctcgaggccgcgctccagacgtgcggctggctcgcgagctacgccggctgcgcgctctcgaccgacggcgcgctgtacttccgcaacctcgacggcaagggcacgctgcacgccgaggtcctgccggcgccggcgccggcagtgagcgcgctgcgcacccgatcgcggctcacgaacatgtcccggtcgggcggcatgatcatcctgtcgttccgggtcgagtgcagcctcggcggcgcgcgggtgtacgacctcgacacggtgttcggcttcttcccgaaggccgcgctcgcgacgcagatcgggatcccgccgaggcccgaggaggtcgccgcgctcgatgagccgtccgatttcgaggtcgatctccgcgagcgccccgcgcggtactgcggcggcaagctcgggctcgcgcggccgtcgctgctgatgatcgaccggatcgacggcctgtggcaggccggcggccggaaggggctcggccggctccgcgcgcggcgggacgtgcacgcgtcggagtggttcttcaaggctcatttcctgggcgatccagtgcagccgggctcgctcggcatcgaggcgatgctgcagacgatccagttctggatgctgcaccaggacctccacgcgggcctccgcgacccgcggttcgagcccgtgatgacggggcacgagcactcctggcggtaccggggccaggtgctgccggccagccggcgggtgacggtcgacaccgacatcctcgaggtcggccgcgacgatcgcgggccctacgtcatcgccgagtcctacctctgggtggacggcctgcgcatctacggcgcgacgctcggcgtgcggatcgtcgacggcgcctcgccgcgggcgcggcgcgacgtcggcttcgacccgcgcgcgagcgcgcgccgcctcgcctcgctcccgggcgccgtgggcgggagcccgcgcctgcgcccgcaggagcagcccgcggcgaaggccgcgccggcgccggcgctcgacgacgtcgaggaggtgctggacccggacgggtgggtcgcggaccaccgccccacgtggacggtcccggcgctccccgggatgagcatggtcgaccggctggccggcgccgcgttgcgggcgcgcccggggagcgtggtcgtggccgtggaggacgtggtggtgcagcgctggctgcccgtgccggggccggtgcgcgtgaaggccgaggcgaccggatccggcgacgtcctcgacgtccggctgctcgcgtggcgcgaggcatcgaacccggcgctctcgcggttcgagcccgtgtgcaccggccgcgtgcgggtggcccgtgactacccgcccgccccggcgccggagccggcgctcgacgcgccggaggcggacgatccgtacgccgcggggacgctgttccacggccctgcgttccagtacctgaccgcgctccgcctcggcgcgcgcgggtcatcggcggtgctggacccccggaggggctcggtgcccgctgggacgctgcaccagggcatgctcgacgcgctgacccataccatcccgcacgaccggctgtcgctgtgggatccggggtgcccgcccgcccagatcgcgttcccgtcgcgcatcccgtcgctccgcctgtacgggccggcgcccgagtcgccggtgcgcgtggaggtgcgttacgagggccgtgacgatcgcttcgtctcgttccgggtgcaggccatcgcgcaggccggggtcgaggcgggagagcgcgtctggctggagctccggctggtcgaggtgctgctcccgcaggggccgatcggcggcgcgcctcccgggatccgccgggcgttcctgcgcgatcgcgcgccggtcgacctcgctgtctcgcgcgtcgacgcggcgtcgggcgaggcgcgctgcagccccgccgacgtgcgcacgatggactggatgcccggcaccgtggcgcagctctacgccgcgtcgggcgacctcgtcgaggcggcggcggtgaaggatcacgtcgcgcggcgcgcgggcgtgcacccgtcgaccgtgtcgctcgccggcgtctcctcggcgcagccgctcacgcgctggccgttcaccgtggcgcgcgagggctccgaggtcgtggtccgcgacgcgggcccgcccgtgatcgacatcgcgcctgtccgccgctactggggcgcggccatgggcatcggccggtggccggcggaggacctgtacttcgggctcatcgagcggttcatccgccgggtgcacgtcgtcgatcccgaggcgttccgcgccgtgaagggccggagcctgctctacctcggcaaccaccaggtcggcgtggagtcgctgctgttcggcatcgccgtgtccggcctgacggaggtctcgacggtgacgctggccaaggccgagcaccggacgacgtggctcggcacgatgctcgcgcactgcttcgcgtacccaggcgcgcgcgatccgaaggtgatcacgtacttcgatcgcgaggacaaggcgtcgctcgggagcatcatcgccgagctcggggccgagatgcagggggccggcaagggcgtgatggtgcacgtcgagggcacgcggtcgctcgagtgccgcacgccggtgcgcaagatgagcggctcgttcatcgacatggcgctcgcggtgggcgtcccggtggtgccggtgcgcttctccggcgcgctgccgccggagccgctcgagcggcggctcgaattcccgctcggcatgggcgtgcaggacatctggatcggccgcccgctgctgcccgaggagctcgcggggctgacctacaaggatcgcaaggacctcgtgatcagcggcatcaacgggctcggcccgagcaacacggaggagcagccgttccccggggatcccgcgttcgcggcgtcggtggacgcgtgggtggacgaggcgggcgtcgcgcacgaggacgcgacggtcttccgggtgctgcaggcgtgcgccgatccgacgccggagacggcggcgatcctggaggccgcgcgcacggggcggctcgtcgcgcccgacgcgcggcgggcggactggctgcggaagctcgccgcacggctcctcgggaggcggctcggggggtga

SEQ ID NO: 2 - protein, 549 aa, Sorangium cellulosum
  SOURCE 1..549: /mol_type="protein" /note="This sequence is generated from feature [CDS]: 1..1650 placed under sequence number 1" /organism="Sorangium cellulosum"
MIEDPQVIRSAGLQPIGIWRSGPWLPAFTSTDLREAVSCVREPVHVVRETPEGRVGVSRGGAVLREDQVNGVPTFPLLGTLPALYPEWLGDRSFVEVHGLRFPYVAGAMANGIHTTRLTIAMAKAGMMGFFGAAGLGLHRIEQAIDEISAALGTDGPTWGCNLIHAPNQPRLESDTVELYLKRGVRRAEAAAYMGLNPMVVRFAYSGVKRLPDGRVDRKNHLFAKISRPEVAARFLSPAPAEILDTCVRNGWLTRDEAELARSLPVAEDITVEADSGGHTDNQPLVALFPVILGVRDELAAKYGYHRPIRVGAAGGLSTPESVAAAFALGAAYVLTGSVNQSCIESGLSDEGKKMLAQADLPDVVMTPAADMFELGVQVQVLKRGTMFGVRAQRLYDLYVAHDSIESLPGDVRARIERELFQMSCDEVWAGCERFFAERDPAELERAAREPKHKMALIFRWYLGMSSKWAIAGDPKRRADYQIWCGPAMGAFNRWVKGSFLEDPARRTAVQVARNLLEGAAVVTRAQQLRTYGVPVPSAAFHFTPRPLA

SEQ ID NO: 3 - protein, 2570 aa, Sorangium cellulosum
  SOURCE 1..2570: /mol_type="protein" /note="This sequence is generated from feature [CDS]: 1677..9389 placed under sequence number 1" /organism="Sorangium cellulosum"
MHPSSSRIPHIAVVGVSAIFPGSLDAHGFWRDILSGTDLITDVPSTHWLVEDYYDPDPSAPDKTYAKRGAFLKDVPFDPLEWGVPPSIVPATDTTQLLALIVAKRVLEDAAQGQFESMSRERMSVILGVTSAQELLASMVSRIQRPVWAKALRDLGYPEDEVKRACDKIAGNYVPWQESSFPGLLGNVVAGRIANRLDLGGTNCVTDAACASSLSAMSMAINELALGQSDLVIAGGCDTMNDAFMYMCFSKTPALSKSGDCRPFSDKADGTLLGEGIAMVALKRLDDAERDGDRVYAVIRGIGSSSDGRSKSVYAPVPEGQAKALRRTYAAAGYGPETVELMEAHGTGTKAGDAAEFEGLRAMFDESGREDRQWCALGSVKSQIGHTKAAAGAAGLFKAIMALHHKVLPPTIKVDKPNPKLDIEKTAFYLNTQARPWIRPGDHPRRASVSSFGFGGSNFHVALEEYTGPAPKAWRVRALPAELFLLSADTPAALADRARALAKEAEVPEILRFLARESVLSFDASRPARLGLCATDEADLRKKLEQVAAHLEARPEQALSAPLVHCASGEAPGRVAFLFPGQGSQYVGMGADALMTFDPARAAWDAAAGVAIADAPLHEVVFPRPVFSDEDRAAQEARLRETRWAQPAIGATSLAHLALLAALGVRAEAFAGHSFGEITALHAAGALSAADLLRVARRRGELMGAASSERGAMIAVPRGIDEVRALGLGGVVIANHNGPKQVVLSGSVAAIEAAEERLKGAGIQARRLDVAAAFHSPLVAEASAPLREFLAGIAVEAPAAPVYSNAEIEPYAGGGDAARDRLARQLAEPVRFVEEIERMYADGVRTFVEVGPGSVLTNLVGDILSGRPHRAVALDRKGKHGVTSLLEAVARLAVAGVPLDARVLWEGFAAPSDPRALPKPKLALQINGSNYGKPYPPQGGAKALPAASPPRAAQKPAPEAARAVVSAPRAVVSASQPVVSASAPVVSAPAPAVSASAPAVSASRPAVSASAPAVSASTSAVASVSAPVVSTSRPAVSASAPAVSTSRPAVSASAPVVSTSRPAVSASTAVVSASRPAVSASWLAAYQEAQRATAEAHSVYQRTMAESHIAFLQAAEASFSGLAALATGAPYPVAPTTVSEVRPAPVLLAPVHAGPVSEASVRPAAAPTARSEGRSSVALDGLNGAGGELPTPVALPAQAAPAVTAKAAVAAPAVTARAVTAAPATAVKAAAAAPVAVSTAVTAPAAAVVTQAAVAAAPRVDIERLVLDVVADKTGYPVSMLGLQMELESDLGIDSIKRVEILSSVRDRTPGLSEVDASALAQLRTLGQVVDHLRASLPAAGPAASASPATAAPAAKASAVAAPAVASGAAPGAAEVEQVVMAVVAETTGYPAEMLGLQMELESDLGIDSIKRVEILSAVRDRTPGLSEVDASALAQLRTLGQVVDHLRASLPAASAGPAVAAPAAKAPAVAAHAVASVAAPGAAEVERVVMAVVAETTGYPAEMLGLQMELESDLGIDSIKRVEILSAVRDRTPGLSEVDASALAQLRTLGQVVDHLRASLPAAGPAASASPAAAASVPKASTAAVPAVASVAAPGAAEVERVVMAVVAETTGYPAEMLGLQMELESDLGIDSIKRVEILSAVRDRTPGLSEVDASALAQLRTLGQVVDHLRASLPAASAGPAVAAPAAKAPAVAAPTGVSGATPGAAEVERVVMAVVAETTGYPAEMLGLQMELESDLGIDSIKRVEILSAVRDRTPGLAEVDASALAQLRTLGQVVDHLRASLGPAAVTAGAAPAEPAEEPASTPLGRWTLVEEPAPAAGLAMPGLFDAGTLVITGHDAIGPALVAALAARGIAAEYAPAVPRGARGAVFLGGLRELATADAALAVHREAFLAAQAIAAKPALFVTVQDTGGDFGLAGSDRAWVGGLPGLVKTAALEWPEASCRAIDLERAGRSDGELAEAIASELLSGGVELEIGLRADGRRTTPRSVRQDAQPGPLPLGPSDVVVASGGARGVTAATLIALARASHARFALLGRTALEDEPAACRGADGEAALKAALVKAATSAGQRVTPAEIGRSVAKILANREVRATLDAIRAAGGEALYVPVDVNDARAVAAALDGVRGALGPVTAIVHGAGVLADKLVAEKTVEQFERVFSTKVDGLRALLGATAGDPLKAIVLFSSIAARGGNKGQCDYAMANEVLNKVAAAEAARRPGCRVKSLGWGPWQGGMVNAALEAHFAQLGVPLIPLAAGAKMLLDELCDASGDRGARGQGGAPPGAVELVLGAEPKALAAQGHGGRVALAVRADRATHPYLGDHAINGVPVVPVVIALEWFARAARACRPDLVVTELRDVRVLRGIKLAAYESGGEVFRVDCREVSNGHGAVLAAELRGPQGALHYAATIQMQQPEGRVAPKGPAAPELGPWPAGGELYDGRTLFHGRDFQVIRRLDGVSRDGIAGTVVGLREAGWVAQPWKTDPAALDGGLQLATLWTQHVLGGAALPMSVGALHTFAEGPSDGPLRAVVRGQIVARDRTKADIAFVDDRGSLVAELRDVQYVLRPDTARGQA

SEQ ID NO: 4 - protein, 2596 aa, Sorangium cellulosum
  SOURCE 1..2596: /mol_type="protein" /note="This sequence is generated from feature [CDS]: 9386..17176 placed under sequence number 1" /organism="Sorangium cellulosum"
VIEASVFEPIAIVGRGCVLPGALHPAALWDNVLAGRDLLSAAPDGRWRLSRERALAQEGPSARGARDVRDAKDRAWSDRGGYVTGFDEHFRRVLASDPFPRRGGTPESLLALDPLFQWVLHAGREALREAGHEGRSDRAGAVLGNLSFPSSAMSAWVESTWLGDLAGVPRPDPRNRFMSGLPAHLLADVLGLGAGAFALDAACASSLYAIALACERLQDREADRMLAGAVCRSDDLFMHIGFCALSAMSRTGQSRPFSSEADGLVPAEGAAFVVLERLSDAEAAGRPILGVIRGIGLSNDGRGRGLLAPSVEGQLRAMRAAYAMAGLDPREVSLLECHATGTPLGDATEIATLKEVFGSREVPLGSLKSNLGHLVTTAGAAGLLKLLGAMAAGVRPPTLHADPLSEAVASSPFRVLQRAEPWEGRRLAGLSAFGFGGNNAHLLVEAYEPSSPRGRAARAAPQAAAAASRPVDAGRPAPAGHLAVVAMGLCVGELSGVRAFAEPLLSGRGADPRRAAVALPADRLRFPPRDLQQALAQQTLLLEAAIEATEGLALPRDRTAVLIGMGADTEVCRYMTRWRLAETAPARLGPSVDVGALQDAIIPALQAAGVVGNMPNIPANRLNSQLDVGGPSFTIAAEELSGPWALRVASRALRAGAVDAAIVGAVDLSCEPAHAAALEALGVRLPPGDAAVVLVLERLDDAVRERHPVLAVVVDEPADPGLVLSSTDLAPRFGHAHAASGLLHVAAAVLACRHGRKPDGAPWSDEIRVAEVRCAGLGGGSLSVRIGAGGPAAPLPPPRSAEGPTLTLPAHPPAIVVPGAASCSSPGDSMEPAPPLPSALDDLPPLYPGPTGFSAADADRAPSWDEPPPVGPAVVTAVAASLAEEPPPVGPAVVAAAAVDIPGDVIAGAAAFTVQLAQIHKEWAEQQAQVHRRFLQMRQRALDSLVQASSGAAAVVVETPLAQVPHAAPVRIEGPRLVDAPRLVDAPPLARAEAPQLARAESPRVVEPPRVVEAPRPSAAPPPAPRPSAQPVLSAAPSVAPRGPRFSREQLEHLASGRISDVFGPLFARQDAYRRQVRMPMPPLLLADRVTGIDAEPGSMKLGTMWTETDVRWDSWYLHDGAMPAGVMIESGQADLLLISWLGADFENKGERVYRLLGCELTFYGGLPRPGDTLVYDIHVDGHAKHGDVRLFFFHYDCRIGGELRLKTRKGQAGFFTDEELASSGGVLWDADTAEPATTARLDPPRIACGKSAFDRADLLAFAAGDGAAAFGPGFDRLSTHVRTPRISAPPMLFFDRVDVFDPAGGPWKRGYLRATLPITKDGWYFEGHFKDDPCMPGTLMFEGCLQALAFYMAAMGFTVDADGFRFEPVPEIPYLLRCRGQVVPASRVLTYEVFVEEVHDGPCPTVFADFLCTVDGLKAFHARRVGLRLSPDWPLTSAPELLDGHVEPVPVARVPWSETGAPPPDGASADAGGFPFDYRSLLSCAWGRPSDAFGPLYRRFDGGQHVARLPGPPYHFMSRVLSVSRPMAAMKAGAEVEVEYDVPEDAWYFDENASLTMPFAVVLEAALQTCGWLASYAGCALSTDGALYFRNLDGKGTLHAEVLPAPAPAVSALRTRSRLTNMSRSGGMIILSFRVECSLGGARVYDLDTVFGFFPKAALATQIGIPPRPEEVAALDEPSDFEVDLRERPARYCGGKLGLARPSLLMIDRIDGLWQAGGRKGLGRLRARRDVHASEWFFKAHFLGDPVQPGSLGIEAMLQTIQFWMLHQDLHAGLRDPRFEPVMTGHEHSWRYRGQVLPASRRVTVDTDILEVGRDDRGPYVIAESYLWVDGLRIYGATLGVRIVDGASPRARRDVGFDPRASARRLASLPGAVGGSPRLRPQEQPAAKAAPAPALDDVEEVLDPDGWVADHRPTWTVPALPGMSMVDRLAGAALRARPGSVVVAVEDVVVQRWLPVPGPVRVKAEATGSGDVLDVRLLAWREASNPALSRFEPVCTGRVRVARDYPPAPAPEPALDAPEADDPYAAGTLFHGPAFQYLTALRLGARGSSAVLDPRRGSVPAGTLHQGMLDALTHTIPHDRLSLWDPGCPPAQIAFPSRIPSLRLYGPAPESPVRVEVRYEGRDDRFVSFRVQAIAQAGVEAGERVWLELRLVEVLLPQGPIGGAPPGIRRAFLRDRAPVDLAVSRVDAASGEARCSPADVRTMDWMPGTVAQLYAASGDLVEAAAVKDHVARRAGVHPSTVSLAGVSSAQPLTRWPFTVAREGSEVVVRDAGPPVIDIAPVRRYWGAAMGIGRWPAEDLYFGLIERFIRRVHVVDPEAFRAVKGRSLLYLGNHQVGVESLLFGIAVSGLTEVSTVTLAKAEHRTTWLGTMLAHCFAYPGARDPKVITYFDREDKASLGSIIAELGAEMQGAGKGVMVHVEGTRSLECRTPVRKMSGSFIDMALAVGVPVVPVRFSGALPPEPLERRLEFPLGMGVQDIWIGRPLLPEELAGLTYKDRKDLVISGINGLGPSNTEEQPFPGDPAFAASVDAWVDEAGVAHEDATVFRVLQACADPTPETAAILEAARTGRLVAPDARRADWLRKLAARLLGRRLGG

SEQ ID NO: 5 - DNA, 1650 bp, Sorangium cellulosum
  source 1..1650: /mol_type="DNA" /organism="Sorangium cellulosum"
  CDS 1..1650: /product="pfa1" /transl_table=11
atgattgaggatccgcaggtcatccgcagcgccggcctccagccgatcggcatctggcgcagcgggccctggctccccgcgttcacatcgacagatttgcgggaggccgtctcctgcgtgcgagagccggtgcacgtggtgcgtgagacgccggaggggcgcgtcggcgtgtcccgcggcggcgctgtcctccgcgaggatcaggtcaacggggtcccgacgttcccgctcctcggaacgctgcccgccctgtacccggagtggctcggagaccgctccttcgtcgaggtccacggcctgcgcttcccgtacgtggccggcgcgatggcgaacggcatccacaccacgcggctcacgatcgcgatggccaaggcaggcatgatggggttcttcggcgccgcaggcctcgggctgcaccggatcgagcaggcgatcgacgagatctcggcggcgctcggcacggacggccccacctggggctgcaacctcatccacgctccgaaccagcccaggctggagagcgacacggtggagctctacctcaagaggggagtccggcgggccgaggcggccgcctacatgggcctgaacccgatggtcgtgcggttcgcctacagcggcgtcaagcgcttgcccgacggccgcgtcgaccggaagaaccacctgttcgcgaagatctcgcgcccggaggtcgccgcgcgcttcctgtcgcccgcgccggccgagatcctcgatacttgcgttcgcaacgggtggctcacccgcgacgaggcggagctcgcgcggagcctcccggtcgccgaggacatcaccgtggaagcggactccggcggtcacaccgacaaccagcccctcgtcgcgctgttcccggtgatcctcggcgtccgcgacgagctcgcggcgaagtacgggtatcaccggccgatccgcgtcggcgccgccggcggcctctccacgccggagtcggtcgccgccgcgttcgcgctcggggcggcgtacgtgctcacgggctcggtcaaccagtcgtgcatcgagtcgggcctgtccgacgagggcaagaagatgctggcccaggccgatctcccggacgtggtgatgacgccggccgccgacatgttcgagctcggcgtgcaggtccaggtgctcaagcgcggcacgatgttcggtgtccgggcgcagcggctctacgacctctacgtcgcccacgactccatcgagtcgctgcccggcgacgtgcgcgcgcgcatcgagagggagctgttccagatgtcgtgcgacgaggtgtgggcgggctgcgagcggttcttcgccgagcgcgacccggccgagctcgagcgcgccgcgcgcgagccgaagcacaagatggcgctgatcttccgctggtatctcggcatgtccagcaagtgggcgatcgccggggacccgaagcgccgcgccgattaccagatctggtgcggcccggccatgggcgcgttcaaccgctgggtcaaggggtcgttcctcgaggacccggcgcgccgcaccgcggtccaggtcgcgcgcaacctgctcgagggcgcggccgtcgtcacgcgcgcgcagcagctccggacgtacggcgtccccgtgccgagcgccgcattccacttcactcctcgcccgctcgcctga

SEQ ID NO: 6 - protein, 549 aa, Sorangium cellulosum; identical to SEQ ID NO: 2
  SOURCE 1..549: /mol_type="protein" /note="This sequence is generated from feature [CDS]:1..1650 placed under sequence number 5" /organism="Sorangium cellulosum"

SEQ ID NO: 7 - DNA, 7713 bp, Sorangium cellulosum
  source 1..7713: /mol_type="DNA" /organism="Sorangium cellulosum"
  CDS 1..7713: /product="pfa2"
atgcatccttcgtcttcgcgtatcccgcacatcgccgtcgtcggcgtgagcgccatcttccccggctcgctcgatgcgcacggcttctggcgcgatatcctgtccgggacagacctcatcacggatgtcccgagcacccactggcttgtcgaggactactacgatcccgacccgtccgccccggacaagacctatgcgaagcgcggcgcctttctcaaggacgtgccgttcgatccgctcgagtggggcgtcccgccttcgatcgtcccggcgacggacacgacgcagctgctcgcgctgatcgtggcgaagcgggtcctggaggacgcggcgcaggggcagttcgagtcgatgagccgcgagcggatgagcgtgatcctcggcgtcacctccgcgcaggagctgctcgcctcgatggtgagccggatccagcggccggtgtgggcgaaggcgctccgggatctcgggtatccggaggacgaggtgaagcgcgcctgcgacaagatcgcgggcaactacgtgccgtggcaggagtcgagctttccgggcctgctcgggaacgtggtggccggtcgcatcgcgaaccggctcgacctcggcgggacgaactgcgtgaccgacgcggcgtgcgcgtcgtcgctgtcggcgatgtcgatggcgatcaacgagctggcgctcggccagtccgatctcgtgatcgcgggcggctgcgacacgatgaacgacgccttcatgtacatgtgcttcagcaagacgcccgcgctgtcgaagtcgggcgactgccggccgttctccgacaaggccgacggcacgctgctcggcgagggcatcgcgatggtggcgctcaagcggctcgacgacgccgagcgcgacggggaccgggtctacgcggtgatccgcgggatcggctcgtcgtcggacgggcggagcaagagcgtgtacgcgccggtgccggaagggcaggcgaaggcgctccgccggacgtacgccgccgccgggtacggccccgagaccgtggagctgatggaggcgcacggcaccgggacgaaggccggcgacgcggccgagttcgagggcctgcgggcgatgttcgacgagtcggggcgcgaagaccgccagtggtgcgcgctcggcagcgtgaagtcgcagatcggccacaccaaggcggcggccggcgcggccggcctgttcaaggcgatcatggccctgcaccacaaggtgctgccgccgaccatcaaggtcgacaagccgaaccccaagctcgacatagaaaagaccgctttctatctcaatacccaggcgcggccgtggatccggccgggggaccacccgcggcgggcgtcggtgagctcgttcggcttcggcggctcgaacttccacgtggcgctggaggagtacacgggcccggcgccgaaggcgtggcgggtgcgggccttgccggcggagctcttcctcctgtcggcggacacgccggcggcgctcgcggatcgcgcgcgggcgctggcgaaggaggcggaggtgcccgagatcctgcgcttcctggcgcgggagtcggtgctctcgttcgacgcgtcgaggccggcgcggctcgggctgtgcgcgacggacgaggcggatctcaggaagaagctcgagcaggtcgcggcgcacctcgaggcgaggccggagcaggcgctctcggcgccgctcgtgcactgcgcgagcggggaggcgccggggcgggtggcgttcctgttcccggggcaggggagccagtacgtcgggatgggcgcggacgcgctcatgacgttcgacccggcccgcgcggcctgggacgcggcggcgggcgtcgcgatcgcggacgcgccgctgcacgaggtggtgttcccgcggccggtgttctcggacgaggaccgggcggcgcaggaggcgcggctccgcgagacgcggtgggcgcagccggcgatcggcgcgacgagcctcgcgcacctcgcgctgctcgcggcgctcggggtacgggccgaggcgttcgcgggccacagcttcggcgagatcacggcgctgcacgcggccggcgcgctgtccgcggcggacctcctgcgcgtggcgcggcggcgcggcgagctgatgggcgcggcgtcgtcggagcggggcgcgatgatcgcggtcccgcgggggatcgacgaggtgcgggcgctgggcctcggcggggtggtgatcgcgaaccacaacggcccgaagcaggtggtgctgtcgggctcggtcgcggcgatcgaggcggcggaggagcggctgaagggcgccgggatccaggcgcggcgcctcgacgtggccgcggcgttccactcgccgctcgtggcggaggcgagcgcgccgctccgcgagttcctggcgggcatcgcggtcgaggcgccggcggcgcccgtgtacagcaacgcggagatcgagccgtacgcgggcggcggcgacgcggcgcgcgaccggctggcgcggcagctcgcggagccggtgcggtttgtggaggagatcgagcggatgtacgcggacggcgtgcgcacgttcgtcgaggtcgggccgggctcggtgctgacgaacctggtcggcgacatcctgagcggccggccgcaccgggcggtggcgctcgaccgcaagggcaagcacggcgtgacgagcctgctcgaggcggtggcgcggctcgccgtggccggggtgccgctggacgcgcgggtcctctgggaaggcttcgcggcgccgagcgatccgcgggcgctgccgaagccgaagctggcgctgcagatcaacggcagcaactacgggaagccgtacccgccgcaggggggcgcgaaggcgctgccggcggcgagcccgccgcgggcggcgcagaagccggcgccagaggcggcgcgggcggtggtgagcgcgccgcgggcggtggtgagcgcgtcgcagcctgtggtgagcgcgtcggcgcctgtggtgagcgcgccggcgccggcagtgagcgcgtcggcgccggcagtgagcgcgtcgcggccggcagtgagcgcgtcggcgccggcagtgagcgcgtcgacgtctgcggtggcgagcgtgtcggcgcctgtggtgagcacgtcgcggccggcagtgagcgcgtcggcgcctgcggtgagcacgtcgcggccggcagtgagcgcgtcggcgcctgtggtgagcacgtcgcggccggcagtgagcgcgtcgacggctgtggtgagcgcgtcgcggccggcggtgagcgcgtcgtggctggccgcgtaccaggaggcgcagcgcgccacggcggaagcccacagcgtgtaccagcgcacgatggccgagagccacatcgcctttctccaggccgccgaggcgtccttctcagggcttgccgcgctggcgaccggcgctccgtacccggtcgccccgacgacggtgtccgaggtgcggcctgcgccggttctcctcgctccggtgcatgcggggcctgtctcggaggcgtccgtacggcctgcagcggcgccgaccgcgcgctccgagggcaggagcagcgtggccctggacggcctgaacggcgcaggcggggagctccccacgcctgtcgcgctgccggcgcaggcggcgcctgccgtgaccgcgaaggcggcagttgcagcgcccgccgtgacagcaagagcggtcacagcggcgcctgctacggctgtgaaggccgcagccgcggcgccagtggcagtgtccacggccgtcaccgcgcccgcggccgccgtggtaacgcaggcggcggtcgccgctgcgccgcgtgtcgatatcgagcggttggtcctcgacgttgtcgcggacaagacgggataccccgtctccatgctcgggctgcagatggagctggagagcgatctcggcatcgacagcatcaagcgggtggagatcctgtcctcggtccgtgaccggacgcccgggctgtcggaggtcgacgcgtcggcgctggcgcagctgcgcacgctggggcaggtcgtcgaccacctccgcgcctcgctgccggccgccgggccggccgccagcgccagtccggctaccgccgcgcccgcggcgaaggcatccgccgtcgcggcgcctgccgtcgcttctggcgcggcgcctggcgcggccgaggtggagcaggtggtgatggcggtcgtcgcggagacgacgggctacccggcggagatgcttgggctgcagatggagctggagagcgacctcggcatcgacagcatcaagcgggtggagatcctgtcggcggtccgcgaccggacgccggggctgtcggaggtggatgcctcggcgctggcgcagctgcgcacgctggggcaggtcgtcgaccacctccgcgcctcgctgccggccgccagcgccggcccggccgtcgccgcgcccgccgcgaaggctcctgccgtcgcggcgcatgcagtcgcgtccgtcgcggcgcctggcgcggccgaggtggagcgcgtcgtgatggcggtcgtcgcggagacgacgggctacccggcggagatgctggggctgcagatggagctggagagcgacctcggcatcgacagcatcaagcgggtggagatcctgtcggcggtccgcgaccggacgcccgggttgtcggaggtcgacgcgtcggcgctggcgcagctgcgcacgctggggcaggtcgtcgaccacctccgcgcctcgctgccagccgccgggccggccgccagcgccagtccggctgccgccgcgtccgtaccgaaggcctccaccgctgcggtgcctgccgtcgcgtccgtcgcggcgcccggcgcggccgaggtggagcgcgtcgtgatggcggtcgtcgcggagacgacgggctacccggcggagatgctggggctgcagatggagctggagagcgacctcggcatcgacagcatcaagcgggtggagatcctgtcggcggtccgcgaccggacgcccgggttgtcggaggtggatgcctcggcgctggcgcagctgcgcacgctggggcaggtcgtcgaccacctccgcgcctcgctgccggccgccagcgccggcccggccgtcgctgcgcccgccgcgaaggctcctgccgttgcggcgcctaccggcgtgtccggcgcgacgcccggcgcggccgaggtggagcgcgtcgtgatggcggtcgtcgcggagacgacgggctacccggcggagatgctggggctgcagatggagctggagagcgacctcggcatcgacagcatcaagcgggtggagatcctgtcggcggtccgcgatcggacgccggggctggcggaggtcgacgcttcggcgctggcgcagctgcgcacgctggggcaggtcgtcgaccacctccgcgcgagcctcggtcccgccgctgtcaccgccggcgctgccccggcggagcccgccgaggagccggcctccacgcccctcggccggtggacgctcgtcgaggagccggcgcccgccgccggcctcgcgatgcccggcctcttcgacgcaggcaccctcgtgatcaccggccacgacgcgatcggccccgcgctcgtcgcggccctcgcggcgcgcgggatcgccgccgagtacgcccccgccgtgccccgcggcgcgcgcggcgccgtgttcctcggcggcctgcgcgagctggccacggccgacgcggcgctcgccgtccaccgcgaggcgttcctcgctgcccaggcgatcgcggcgaagccggccctcttcgtcacggtccaggacaccggcggcgacttcggcctcgcgggctcggaccgagcctgggtcggcgggctgccgggcctcgtgaagaccgcggcgctggagtggcccgaggcgtcctgccgcgcgatcgacctcgagcgtgccggccggtccgacggcgagctcgcggaggccatcgcctcggagctcctgtccggcggcgtcgagctcgagatcggcctgcgcgcggacggccggcgcaccacgccgcgcagcgtccggcaggacgcgcagcccgggccgctccccctcgggccgtccgacgtggtcgtggcgagcggcggcgcccgcggcgtcaccgcggcgacgctgatcgcgctcgccagggccagccacgcgcggttcgcgctgctcggccgcaccgcgctcgaggacgagccggccgcctgccgcggcgccgacggcgaggccgcgctcaaggcagcgctcgtcaaggcggcgacctccgcgggccagcgggtgaccccggccgagatcggccggagcgtcgcgaagatcctcgcgaaccgcgaggtccgcgcgacgctcgacgcgatccgcgccgccggcggcgaggccctctacgtccctgtcgacgtgaacgacgcgcgggcggtggccgcggcgctcgacggcgtgcgcggcgccctcggccccgtcacggcgatcgtccacggcgccggcgtgctcgccgacaagctcgtcgccgagaagacggtcgagcagttcgagcgcgtgttcagcacgaaggtcgacggcctccgggccctgctcggcgcgacagcgggcgacccgctcaaggcgatcgtcctcttcagctcgatcgccgcgcgcggcggcaacaaggggcagtgcgactacgcgatggcgaacgaggtcctgaacaaggtcgcggccgccgaggcagcccgccgcccgggctgccgggtgaagtcgctcggctgggggccctggcaaggcggcatggtgaacgcggcgctcgaggcccacttcgcgcagctcggcgtgccgctcatcccgctcgccgcgggcgcgaagatgctcctcgacgagctgtgcgacgcctcgggtgatcgcggcgcgcgcgggcaaggcggcgccccgcccggcgcggtcgagctcgtgctcggcgcggagccgaaggcgctcgcggcccaaggccacggcggccgggtcgcgctggccgtccgcgcggaccgcgcgacgcacccctacctcggcgatcacgccatcaacggcgtgcccgtggtgcctgtggtgatcgcgctcgagtggttcgcccgcgccgcgcgcgcgtgccggccggatctcgtcgtgaccgagctccgcgacgtgcgggtcctgcgcgggatcaagctcgcggcgtacgagtccggcggcgaggtgttccgcgtcgactgccgcgaggtgagcaacggccacggcgcggtgctcgcggcggagctgcgcgggccgcagggggcgctgcactacgcggcgaccatccagatgcagcagcccgaagggcgcgtggccccgaagggcccggccgcgccggagctcggcccgtggcccgccggcggcgagctgtacgacggccgcacgctcttccacggccgcgacttccaggtgatccggcggctcgacggcgtgagccgcgacgggatcgcggggacggtcgtgggcctccgcgaggccggctgggtggcccagccgtggaagaccgatccggcggcgctcgacggcgggctgcagctcgcgacgctgtggacgcagcacgtgctcggcggcgcggcgctcccgatgtccgtgggcgcgctgcacaccttcgcggaggggccgtccgacggcccgctgcgcgcggtggtgcgcgggcagatcgtggcccgcgatcgcacgaaggccgacatcgcgttcgttgacgaccgcggctcgctcgtcgcggagctgcgcgacgtgcagtacgtcctgcgccccgacacggcgcgcggccaggcgtga

SEQ ID NO: 8 - protein, 2570 aa, Sorangium cellulosum; identical to SEQ ID NO: 3
  SOURCE 1..2570: /mol_type="protein" /note="This sequence is generated from feature [CDS]:1..7713 plac ed under sequence number 7" /organism="Sorangium cellulosum"

SEQ ID NO: 9 - DNA, 7791 bp, Sorangium cellulosum
  source 1..7791: /mol_type="DNA" /organism="Sorangium cellulosum"
  CDS 1..7791: /product="pfa3"
gtgatcgaggccagcgtgttcgagcccatcgcgatcgtcggccgcgggtgcgtcctcccgggcgcgctccaccccgcggccctctgggacaacgtgctcgccggccgggacctcctgtccgccgcgcccgacggccgctggcgcctctcgcgcgagcgcgcgctcgcgcaggaggggccttccgcgcgcggcgcgcgcgacgtgcgcgacgcgaaggaccgcgcgtggagcgaccgcggcggctacgtcaccgggttcgacgagcacttccgccgcgtgctcgcgagcgacccgttcccgcggcggggcgggacgcccgagtcgctgctcgcgctcgacccgctcttccagtgggtgctccacgcgggccgcgaggcgctgcgcgaggcgggccacgagggccggtccgaccgcgcgggcgcggtgctcgggaacctctcgttcccgtcgtcggccatgtcggcgtgggtcgagtcgacgtggctcggcgatctcgccggcgtcccgcgccccgatccgcgcaaccggttcatgtcggggctgcccgcccacctgctggccgacgtgctcggcctcggggccggggcgttcgcgctcgacgccgcgtgcgcgtcgtcgctgtacgcgatcgcgctcgcctgcgagcggctgcaggatcgcgaggccgaccggatgctcgcgggcgcggtgtgccgctcggacgacctcttcatgcacatcgggttctgcgcgctgtcggccatgagccgcaccgggcagagccgcccgttctcgtcggaggccgacggcctggtcccggcggagggcgcggcgttcgttgtcctggagcgcctgtcggacgcggaggccgcgggcaggccgatcctcggcgtgatccgcgggatcggcctgtcgaacgacggccgcggccgcggcctcctggcgccctccgtcgagggccagctgcgcgcgatgcgggccgcgtacgccatggcgggcctcgatccccgcgaggtgtcgctgctcgagtgccacgcgacgggcacgcccctcggcgacgcgaccgagatcgcgaccctcaaggaggtgttcggctcccgcgaggtcccgctcggctcgctcaagtcgaacctcggtcacctcgtcacgacggccggcgcggccgggctcctcaagctgctcggcgccatggcggccggcgtccgcccgccgacgctgcacgccgatccgctgagcgaggcggtggcctcgagccccttccgggtgctgcagcgcgccgagccgtgggaggggcggcggctcgcgggcctgtcggcgttcgggttcggcgggaacaatgcccacctcctcgtggaggcgtacgagccgtcctcgccgaggggccgcgcggcccgcgccgcgccgcaggccgccgcggcggcctcgcgccctgtcgacgccgggcgccccgcgccggcaggccacctggccgtggtggccatgggcctgtgcgtcggtgagctcagcggcgtccgggccttcgcggagccgctcctctcgggccgcggcgcggatccccgccgggcggcggtcgcgctgcccgcggatcggctccggtttccgccgcgcgatctgcagcaggcgctcgcccagcagacgctgctgctcgaggcggcgatcgaggccaccgaggggctcgcgctgccgcgcgatcgcaccgccgtgctgatcggcatgggcgccgacaccgaggtgtgccggtacatgacgcgctggcggctcgccgagacggcgccggcgcggctcggtccgtcggtcgacgtcggcgcgctccaggacgcgatcatccctgcgctgcaggcggcgggcgtcgtcgggaacatgcccaacatcccggcgaaccggctgaacagccagctcgacgtcggtggaccgtcgttcacgatcgcggccgaggagctgtccggcccctgggcgctgcgcgtcgcgtcccgcgccctgcgcgccggcgcggtggacgcggcgatcgtcggcgcggtggatctctcgtgcgagcccgcccacgcggctgcgctcgaggcgctcggcgtccgcctgccccccggcgacgccgccgtggtgctcgtgctcgagcgcctcgacgacgccgtccgggagcggcacccggtcctggccgttgtcgtggacgagccggccgaccctggcctcgtgctgtcgtccacggatctcgcgccgcggttcggccacgcgcacgcggcctcgggcctgctgcacgtggccgccgcggtgctcgcctgccgtcacggccgcaagcccgacggggcgccgtggtccgacgagatccgggtcgccgaggtccgctgcgccggcctcggcggcggctcgctgtcggtccgcatcggggccggcggccccgccgcgccgctcccgccgccgcgatcggcggaggggccgacgctgacgctccccgcccacccgccggcgatcgtcgtgcccggcgcggcctcctgttcatcccccggagactccatggaacctgcgccgcctctgccgtccgctctcgacgacctgccgccgctgtaccccgggcccacggggttctctgccgccgacgcggatcgggcgccgtcctgggacgagccgccgccggtcgggccggcggtcgtcacggccgtcgccgcgagcctcgcagaggagccgccgccggtcggaccggccgtcgtcgcggccgctgccgtggacatcccgggcgacgtgatcgccggcgccgcggcgttcaccgtgcagctggcgcagatccacaaggagtgggcggagcagcaggcccaggtccaccgccggttccttcagatgcggcagcgcgcgctggactcgctcgtgcaggcgtcgtcgggcgcggccgcggtggtggtcgagacccccttggcgcaggtgccccacgccgcgccggtccgtatcgaggggccgcgcctggtcgatgcgccgcgcctggtcgatgcgccgccgctcgcccgcgccgaggcgccgcagctcgctcgcgccgagtcgccgcgtgtcgttgaaccgccgcgcgtcgtcgaggccccgcgcccctccgccgcgccgccccctgcgccgcgtccctccgcccagccggtgctctccgcggcgccttccgtcgcgccccgcggcccccggttcagccgcgagcagctcgagcacctcgcctcggggcggatctccgacgtgttcggcccgctcttcgcccggcaggacgcctatcgccgccaggtgcgcatgcccatgccgccgctgctgctcgccgatcgggtcaccgggatcgacgccgagcccggctcgatgaagctcggcacgatgtggaccgagaccgacgtgcggtgggattcctggtacctgcacgacggcgcgatgccggccggcgtcatgatcgagagcggccaggccgacctgctgctcatcagctggctcggcgcggacttcgagaacaagggcgagcgcgtctaccgcctgctcggctgcgagctcaccttctacggcggcctgccgcgcccgggcgacacgctcgtctacgacatccacgtcgacgggcacgcgaagcacggcgacgtccgcctgttcttcttccactacgactgccggatcggcggcgagctgcgcctgaagacgcgcaagggccaggccggcttcttcaccgacgaggagctcgcgagctccggcggcgtgctctgggacgcggacaccgccgagcccgcgacgaccgcccgcctcgatccgccccggatcgcgtgcgggaagtccgcgttcgaccgggccgacctcctcgcgttcgcggccggagacggcgcggcggcgttcggccccggcttcgatcgtctgagcacccacgtcaggacgccgcggatcagcgctccgcccatgctgttcttcgatcgcgtcgacgtgttcgacccggcgggcggcccgtggaagcgcggctatctccgggccacgctgccgatcacgaaggacggctggtacttcgagggccacttcaaggacgacccctgcatgccggggacgctcatgttcgagggctgcctgcaggcgctcgcgttctacatggcggccatgggcttcacggtggacgcggacggcttccgcttcgagcccgtgccggagatcccgtacctgctccgctgccgcggccaggtggtcccggcgagccgcgtgctcacgtacgaggtgttcgtcgaggaggtccacgacggcccgtgcccgacggtgttcgccgacttcctgtgcacggtcgacggcctcaaggcgttccacgcccgccgcgtgggcctgcgcctcagccccgactggccgctgacgagcgcccccgagctgctcgacggccacgtcgagccggtgccggtcgcgcgcgtcccctggtccgagacgggcgcgccgccgccggacggcgcctctgcagacgccggcggcttcccgttcgattaccggagcctgctctcgtgcgcctggggcaggccgtcggacgcgttcggcccgctctaccgcaggttcgacgggggccagcacgtcgcccggctcccggggccgccgtaccacttcatgagccgggtcctgtcggtctcgcgccccatggcggcgatgaaggccggcgccgaggtcgaggtcgagtacgacgtcccggaggacgcgtggtacttcgacgagaacgcgagcctcacgatgccgttcgcggtggtgctcgaggccgcgctccagacgtgcggctggctcgcgagctacgccggctgcgcgctctcgaccgacggcgcgctgtacttccgcaacctcgacggcaagggcacgctgcacgccgaggtcctgccggcgccggcgccggcagtgagcgcgctgcgcacccgatcgcggctcacgaacatgtcccggtcgggcggcatgatcatcctgtcgttccgggtcgagtgcagcctcggcggcgcgcgggtgtacgacctcgacacggtgttcggcttcttcccgaaggccgcgctcgcgacgcagatcgggatcccgccgaggcccgaggaggtcgccgcgctcgatgagccgtccgatttcgaggtcgatctccgcgagcgccccgcgcggtactgcggcggcaagctcgggctcgcgcggccgtcgctgctgatgatcgaccggatcgacggcctgtggcaggccggcggccggaaggggctcggccggctccgcgcgcggcgggacgtgcacgcgtcggagtggttcttcaaggctcatttcctgggcgatccagtgcagccgggctcgctcggcatcgaggcgatgctgcagacgatccagttctggatgctgcaccaggacctccacgcgggcctccgcgacccgcggttcgagcccgtgatgacggggcacgagcactcctggcggtaccggggccaggtgctgccggccagccggcgggtgacggtcgacaccgacatcctcgaggtcggccgcgacgatcgcgggccctacgtcatcgccgagtcctacctctgggtggacggcctgcgcatctacggcgcgacgctcggcgtgcggatcgtcgacggcgcctcgccgcgggcgcggcgcgacgtcggcttcgacccgcgcgcgagcgcgcgccgcctcgcctcgctcccgggcgccgtgggcgggagcccgcgcctgcgcccgcaggagcagcccgcggcgaaggccgcgccggcgccggcgctcgacgacgtcgaggaggtgctggacccggacgggtgggtcgcggaccaccgccccacgtggacggtcccggcgctccccgggatgagcatggtcgaccggctggccggcgccgcgttgcgggcgcgcccggggagcgtggtcgtggccgtggaggacgtggtggtgcagcgctggctgcccgtgccggggccggtgcgcgtgaaggccgaggcgaccggatccggcgacgtcctcgacgtccggctgctcgcgtggcgcgaggcatcgaacccggcgctctcgcggttcgagcccgtgtgcaccggccgcgtgcgggtggcccgtgactacccgcccgccccggcgccggagccggcgctcgacgcgccggaggcggacgatccgtacgccgcggggacgctgttccacggccctgcgttccagtacctgaccgcgctccgcctcggcgcgcgcgggtcatcggcggtgctggacccccggaggggctcggtgcccgctgggacgctgcaccagggcatgctcgacgcgctgacccataccatcccgcacgaccggctgtcgctgtgggatccggggtgcccgcccgcccagatcgcgttcccgtcgcgcatcccgtcgctccgcctgtacgggccggcgcccgagtcgccggtgcgcgtggaggtgcgttacgagggccgtgacgatcgcttcgtctcgttccgggtgcaggccatcgcgcaggccggggtcgaggcgggagagcgcgtctggctggagctccggctggtcgaggtgctgctcccgcaggggccgatcggcggcgcgcctcccgggatccgccgggcgttcctgcgcgatcgcgcgccggtcgacctcgctgtctcgcgcgtcgacgcggcgtcgggcgaggcgcgctgcagccccgccgacgtgcgcacgatggactggatgcccggcaccgtggcgcagctctacgccgcgtcgggcgacctcgtcgaggcggcggcggtgaaggatcacgtcgcgcggcgcgcgggcgtgcacccgtcgaccgtgtcgctcgccggcgtctcctcggcgcagccgctcacgcgctggccgttcaccgtggcgcgcgagggctccgaggtcgtggtccgcgacgcgggcccgcccgtgatcgacatcgcgcctgtccgccgctactggggcgcggccatgggcatcggccggtggccggcggaggacctgtacttcgggctcatcgagcggttcatccgccgggtgcacgtcgtcgatcccgaggcgttccgcgccgtgaagggccggagcctgctctacctcggcaaccaccaggtcggcgtggagtcgctgctgttcggcatcgccgtgtccggcctgacggaggtctcgacggtgacgctggccaaggccgagcaccggacgacgtggctcggcacgatgctcgcgcactgcttcgcgtacccaggcgcgcgcgatccgaaggtgatcacgtacttcgatcgcgaggacaaggcgtcgctcgggagcatcatcgccgagctcggggccgagatgcagggggccggcaagggcgtgatggtgcacgtcgagggcacgcggtcgctcgagtgccgcacgccggtgcgcaagatgagcggctcgttcatcgacatggcgctcgcggtgggcgtcccggtggtgccggtgcgcttctccggcgcgctgccgccggagccgctcgagcggcggctcgaattcccgctcggcatgggcgtgcaggacatctggatcggccgcccgctgctgcccgaggagctcgcggggctgacctacaaggatcgcaaggacctcgtgatcagcggcatcaacgggctcggcccgagcaacacggaggagcagccgttccccggggatcccgcgttcgcggcgtcggtggacgcgtgggtggacgaggcgggcgtcgcgcacgaggacgcgacggtcttccgggtgctgcaggcgtgcgccgatccgacgccggagacggcggcgatcctggaggccgcgcgcacggggcggctcgtcgcgcccgacgcgcggcgggcggactggctgcggaagctcgccgcacggctcctcgggaggcggctcggggggtga

SEQ ID NO: 10 - protein, 2596 aa, Sorangium cellulosum; identical to SEQ ID NO: 4
  SOURCE 1..2596: /mol_type="protein" /note="This sequence is generated from feature [CDS]:1..7791 placed under sequence number 9" /organism="Sorangium cellulosum"

SEQ ID NO: 11 - DNA, 1650 bp, Sorangium cellulosum; identical to SEQ ID NO: 5
  source 1..1650: /mol_type="DNA" /organism="Sorangium cellulosum"
  CDS 1..1650: /product="domain I" /transl_table=1

SEQ ID NO: 12 - protein, 549 aa, Sorangium cellulosum; identical to SEQ ID NO: 2
  SOURCE 1..549: /mol_type="protein" /note="This sequence is generated from feature [CDS]:1..1650 placed under sequence number 11" /organism="Sorangium cellulosum"

SEQ ID NO: 13 - protein, 549 aa, Sorangium cellulosum; identical to SEQ ID NO: 2
  DOMAIN 1..549: "domain I"
  SOURCE 1..549: /mol_type="protein" /organism="Sorangium cellulosum"

SEQ ID NO: 14 - DNA, 3549 bp, Sorangium cellulosum
  source 1..3549: /mol_type="DNA" /organism="Sorangium cellulosum"
  CDS 1..3549: /codon_start=1 /gene="domain IIa" /transl_table=11
atgcatccttcgtcttcgcgtatcccgcacatcgccgtcgtcggcgtgagcgccatcttccccggctcgctcgatgcgcacggcttctggcgcgatatcctgtccgggacagacctcatcacggatgtcccgagcacccactggcttgtcgaggactactacgatcccgacccgtccgccccggacaagacctatgcgaagcgcggcgcctttctcaaggacgtgccgttcgatccgctcgagtggggcgtcccgccttcgatcgtcccggcgacggacacgacgcagctgctcgcgctgatcgtggcgaagcgggtcctggaggacgcggcgcaggggcagttcgagtcgatgagccgcgagcggatgagcgtgatcctcggcgtcacctccgcgcaggagctgctcgcctcgatggtgagccggatccagcggccggtgtgggcgaaggcgctccgggatctcgggtatccggaggacgaggtgaagcgcgcctgcgacaagatcgcgggcaactacgtgccgtggcaggagtcgagctttccgggcctgctcgggaacgtggtggccggtcgcatcgcgaaccggctcgacctcggcgggacgaactgcgtgaccgacgcggcgtgcgcgtcgtcgctgtcggcgatgtcgatggcgatcaacgagctggcgctcggccagtccgatctcgtgatcgcgggcggctgcgacacgatgaacgacgccttcatgtacatgtgcttcagcaagacgcccgcgctgtcgaagtcgggcgactgccggccgttctccgacaaggccgacggcacgctgctcggcgagggcatcgcgatggtggcgctcaagcggctcgacgacgccgagcgcgacggggaccgggtctacgcggtgatccgcgggatcggctcgtcgtcggacgggcggagcaagagcgtgtacgcgccggtgccggaagggcaggcgaaggcgctccgccggacgtacgccgccgccgggtacggccccgagaccgtggagctgatggaggcgcacggcaccgggacgaaggccggcgacgcggccgagttcgagggcctgcgggcgatgttcgacgagtcggggcgcgaagaccgccagtggtgcgcgctcggcagcgtgaagtcgcagatcggccacaccaaggcggcggccggcgcggccggcctgttcaaggcgatcatggccctgcaccacaaggtgctgccgccgaccatcaaggtcgacaagccgaaccccaagctcgacatagaaaagaccgctttctatctcaatacccaggcgcggccgtggatccggccgggggaccacccgcggcgggcgtcggtgagctcgttcggcttcggcggctcgaacttccacgtggcgctggaggagtacacgggcccggcgccgaaggcgtggcgggtgcgggccttgccggcggagctcttcctcctgtcggcggacacgccggcggcgctcgcggatcgcgcgcgggcgctggcgaaggaggcggaggtgcccgagatcctgcgcttcctggcgcgggagtcggtgctctcgttcgacgcgtcgaggccggcgcggctcgggctgtgcgcgacggacgaggcggatctcaggaagaagctcgagcaggtcgcggcgcacctcgaggcgaggccggagcaggcgctctcggcgccgctcgtgcactgcgcgagcggggaggcgccggggcgggtggcgttcctgttcccggggcaggggagccagtacgtcgggatgggcgcggacgcgctcatgacgttcgacccggcccgcgcggcctgggacgcggcggcgggcgtcgcgatcgcggacgcgccgctgcacgaggtggtgttcccgcggccggtgttctcggacgaggaccgggcggcgcaggaggcgcggctccgcgagacgcggtgggcgcagccggcgatcggcgcgacgagcctcgcgcacctcgcgctgctcgcggcgctcggggtacgggccgaggcgttcgcgggccacagcttcggcgagatcacggcgctgcacgcggccggcgcgctgtccgcggcggacctcctgcgcgtggcgcggcggcgcggcgagctgatgggcgcggcgtcgtcggagcggggcgcgatgatcgcggtcccgcgggggatcgacgaggtgcgggcgctgggcctcggcggggtggtgatcgcgaaccacaacggcccgaagcaggtggtgctgtcgggctcggtcgcggcgatcgaggcggcggaggagcggctgaagggcgccgggatccaggcgcggcgcctcgacgtggccgcggcgttccactcgccgctcgtggcggaggcgagcgcgccgctccgcgagttcctggcgggcatcgcggtcgaggcgccggcggcgcccgtgtacagcaacgcggagatcgagccgtacgcgggcggcggcgacgcggcgcgcgaccggctggcgcggcagctcgcggagccggtgcggtttgtggaggagatcgagcggatgtacgcggacggcgtgcgcacgttcgtcgaggtcgggccgggctcggtgctgacgaacctggtcggcgacatcctgagcggccggccgcaccgggcggtggcgctcgaccgcaagggcaagcacggcgtgacgagcctgctcgaggcggtggcgcggctcgccgtggccggggtgccgctggacgcgcgggtcctctgggaaggcttcgcggcgccgagcgatccgcgggcgctgccgaagccgaagctggcgctgcagatcaacggcagcaactacgggaagccgtacccgccgcaggggggcgcgaaggcgctgccggcggcgagcccgccgcgggcggcgcagaagccggcgccagaggcggcgcgggcggtggtgagcgcgccgcgggcggtggtgagcgcgtcgcagcctgtggtgagcgcgtcggcgcctgtggtgagcgcgccggcgccggcagtgagcgcgtcggcgccggcagtgagcgcgtcgcggccggcagtgagcgcgtcggcgccggcagtgagcgcgtcgacgtctgcggtggcgagcgtgtcggcgcctgtggtgagcacgtcgcggccggcagtgagcgcgtcggcgcctgcggtgagcacgtcgcggccggcagtgagcgcgtcggcgcctgtggtgagcacgtcgcggccggcagtgagcgcgtcgacggctgtggtgagcgcgtcgcggccggcggtgagcgcgtcgtggctggccgcgtaccaggaggcgcagcgcgccacggcggaagcccacagcgtgtaccagcgcacgatggccgagagccacatcgcctttctccaggccgccgaggcgtccttctcagggcttgccgcgctggcgaccggcgctccgtacccggtcgccccgacgacggtgtccgaggtgcggcctgcgccggttctcctcgctccggtgcatgcggggcctgtctcggaggcgtccgtacggcctgcagcggcgccgaccgcgcgctccgagggcaggagcagcgtggccctggacggcctgaac

SEQ ID NO: 15 - protein, 1183 aa, Sorangium cellulosum
  SOURCE 1..1183: /mol_type="protein" /note="This sequence is generated from feature [CDS]:1..3549 placed under sequence number 14" /organism="Sorangium cellulosum"
MHPSSSRIPHIAVVGVSAIFPGSLDAHGFWRDILSGTDLITDVPSTHWLVEDYYDPDPSAPDKTYAKRGAFLKDVPFDPLEWGVPPSIVPATDTTQLLALIVAKRVLEDAAQGQFESMSRERMSVILGVTSAQELLASMVSRIQRPVWAKALRDLGYPEDEVKRACDKIAGNYVPWQESSFPGLLGNVVAGRIANRLDLGGTNCVTDAACASSLSAMSMAINELALGQSDLVIAGGCDTMNDAFMYMCFSKTPALSKSGDCRPFSDKADGTLLGEGIAMVALKRLDDAERDGDRVYAVIRGIGSSSDGRSKSVYAPVPEGQAKALRRTYAAAGYGPETVELMEAHGTGTKAGDAAEFEGLRAMFDESGREDRQWCALGSVKSQIGHTKAAAGAAGLFKAIMALHHKVLPPTIKVDKPNPKLDIEKTAFYLNTQARPWIRPGDHPRRASVSSFGFGGSNFHVALEEYTGPAPKAWRVRALPAELFLLSADTPAALADRARALAKEAEVPEILRFLARESVLSFDASRPARLGLCATDEADLRKKLEQVAAHLEARPEQALSAPLVHCASGEAPGRVAFLFPGQGSQYVGMGADALMTFDPARAAWDAAAGVAIADAPLHEVVFPRPVFSDEDRAAQEARLRETRWAQPAIGATSLAHLALLAALGVRAEAFAGHSFGEITALHAAGALSAADLLRVARRRGELMGAASSERGAMIAVPRGIDEVRALGLGGVVIANHNGPKQVVLSGSVAAIEAAEERLKGAGIQARRLDVAAAFHSPLVAEASAPLREFLAGIAVEAPAAPVYSNAEIEPYAGGGDAARDRLARQLAEPVRFVEEIERMYADGVRTFVEVGPGSVLTNLVGDILSGRPHRAVALDRKGKHGVTSLLEAVARLAVAGVPLDARVLWEGFAAPSDPRALPKPKLALQINGSNYGKPYPPQGGAKALPAASPPRAAQKPAPEAARAVVSAPRAVVSASQPVVSASAPVVSAPAPAVSASAPAVSASRPAVSASAPAVSASTSAVASVSAPVVSTSRPAVSASAPAVSTSRPAVSASAPVVSTSRPAVSASTAVVSASRPAVSASWLAAYQEAQRATAEAHSVYQRTMAESHIAFLQAAEASFSGLAALATGAPYPVAPTTVSEVRPAPVLLAPVHAGPVSEASVRPAAAPTARSEGRSSVALDGLN

SEQ ID NO: 16 - protein, 1183 aa, Sorangium cellulosum; identical to SEQ ID NO: 15
  SOURCE 1..1183: /mol_type="protein" /organism="Sorangium cellulosum"

SEQ ID NO: 17 - DNA, 1776 bp, Sorangium cellulosum
  source 1..1776: /mol_type="DNA" /organism="Sorangium cellulosum"
  CDS 1..1776: /codon_start=1 /gene="domain IIb" /transl_table=11
ggcgcaggcggggagctccccacgcctgtcgcgctgccggcgcaggcggcgcctgccgtgaccgcgaaggcggcagttgcagcgcccgccgtgacagcaagagcggtcacagcggcgcctgctacggctgtgaaggccgcagccgcggcgccagtggcagtgtccacggccgtcaccgcgcccgcggccgccgtggtaacgcaggcggcggtcgccgctgcgccgcgtgtcgatatcgagcggttggtcctcgacgttgtcgcggacaagacgggataccccgtctccatgctcgggctgcagatggagctggagagcgatctcggcatcgacagcatcaagcgggtggagatcctgtcctcggtccgtgaccggacgcccgggctgtcggaggtcgacgcgtcggcgctggcgcagctgcgcacgctggggcaggtcgtcgaccacctccgcgcctcgctgccggccgccgggccggccgccagcgccagtccggctaccgccgcgcccgcggcgaaggcatccgccgtcgcggcgcctgccgtcgcttctggcgcggcgcctggcgcggccgaggtggagcaggtggtgatggcggtcgtcgcggagacgacgggctacccggcggagatgcttgggctgcagatggagctggagagcgacctcggcatcgacagcatcaagcgggtggagatcctgtcggcggtccgcgaccggacgccggggctgtcggaggtggatgcctcggcgctggcgcagctgcgcacgctggggcaggtcgtcgaccacctccgcgcctcgctgccggccgccagcgccggcccggccgtcgccgcgcccgccgcgaaggctcctgccgtcgcggcgcatgcagtcgcgtccgtcgcggcgcctggcgcggccgaggtggagcgcgtcgtgatggcggtcgtcgcggagacgacgggctacccggcggagatgctggggctgcagatggagctggagagcgacctcggcatcgacagcatcaagcgggtggagatcctgtcggcggtccgcgaccggacgcccgggttgtcggaggtcgacgcgtcggcgctggcgcagctgcgcacgctggggcaggtcgtcgaccacctccgcgcctcgctgccagccgccgggccggccgccagcgccagtccggctgccgccgcgtccgtaccgaaggcctccaccgctgcggtgcctgccgtcgcgtccgtcgcggcgcccggcgcggccgaggtggagcgcgtcgtgatggcggtcgtcgcggagacgacgggctacccggcggagatgctggggctgcagatggagctggagagcgacctcggcatcgacagcatcaagcgggtggagatcctgtcggcggtccgcgaccggacgcccgggttgtcggaggtggatgcctcggcgctggcgcagctgcgcacgctggggcaggtcgtcgaccacctccgcgcctcgctgccggccgccagcgccggcccggccgtcgctgcgcccgccgcgaaggctcctgccgttgcggcgcctaccggcgtgtccggcgcgacgcccggcgcggccgaggtggagcgcgtcgtgatggcggtcgtcgcggagacgacgggctacccggcggagatgctggggctgcagatggagctggagagcgacctcggcatcgacagcatcaagcgggtggagatcctgtcggcggtccgcgatcggacgccggggctggcggaggtcgacgcttcggcgctggcgcagctgcgcacgctgggg

SEQ ID NO: 18 - protein, 592 aa, Sorangium cellulosum
  SOURCE 1..592: /mol_type="protein" /note="This sequence is generated from feature [CDS]:1..1776 placed under sequence number 17" /organism="Sorangium cellulosum"
GAGGELPTPVALPAQAAPAVTAKAAVAAPAVTARAVTAAPATAVKAAAAAPVAVSTAVTAPAAAVVTQAAVAAAPRVDIERLVLDVVADKTGYPVSMLGLQMELESDLGIDSIKRVEILSSVRDRTPGLSEVDASALAQLRTLGQVVDHLRASLPAAGPAASASPATAAPAAKASAVAAPAVASGAAPGAAEVEQVVMAVVAETTGYPAEMLGLQMELESDLGIDSIKRVEILSAVRDRTPGLSEVDASALAQLRTLGQVVDHLRASLPAASAGPAVAAPAAKAPAVAAHAVASVAAPGAAEVERVVMAVVAETTGYPAEMLGLQMELESDLGIDSIKRVEILSAVRDRTPGLSEVDASALAQLRTLGQVVDHLRASLPAAGPAASASPAAAASVPKASTAAVPAVASVAAPGAAEVERVVMAVVAETTGYPAEMLGLQMELESDLGIDSIKRVEILSAVRDRTPGLSEVDASALAQLRTLGQVVDHLRASLPAASAGPAVAAPAAKAPAVAAPTGVSGATPGAAEVERVVMAVVAETTGYPAEMLGLQMELESDLGIDSIKRVEILSAVRDRTPGLAEVDASALAQLRTLG

SEQ ID NO: 19 - protein, 592 aa, Sorangium cellulosum; identical to SEQ ID NO: 18
  SOURCE 1..592: /mol_type="protein" /organism="Sorangium cellulosum"

SEQ ID NO: 20 - DNA, 2388 bp, Sorangium cellulosum
  source 1..2388: /mol_type="DNA" /organism="Sorangium cellulosum"
  CDS 1..2388: /codon_start=1 /gene="domain IIc" /transl_table=11
caggtcgtcgaccacctccgcgcgagcctcggtcccgccgctgtcaccgccggcgctgccccggcggagcccgccgaggagccggcctccacgcccctcggccggtggacgctcgtcgaggagccggcgcccgccgccggcctcgcgatgcccggcctcttcgacgcaggcaccctcgtgatcaccggccacgacgcgatcggccccgcgctcgtcgcggccctcgcggcgcgcgggatcgccgccgagtacgcccccgccgtgccccgcggcgcgcgcggcgccgtgttcctcggcggcctgcgcgagctggccacggccgacgcggcgctcgccgtccaccgcgaggcgttcctcgctgcccaggcgatcgcggcgaagccggccctcttcgtcacggtccaggacaccggcggcgacttcggcctcgcgggctcggaccgagcctgggtcggcgggctgccgggcctcgtgaagaccgcggcgctggagtggcccgaggcgtcctgccgcgcgatcgacctcgagcgtgccggccggtccgacggcgagctcgcggaggccatcgcctcggagctcctgtccggcggcgtcgagctcgagatcggcctgcgcgcggacggccggcgcaccacgccgcgcagcgtccggcaggacgcgcagcccgggccgctccccctcgggccgtccgacgtggtcgtggcgagcggcggcgcccgcggcgtcaccgcggcgacgctgatcgcgctcgccagggccagccacgcgcggttcgcgctgctcggccgcaccgcgctcgaggacgagccggccgcctgccgcggcgccgacggcgaggccgcgctcaaggcagcgctcgtcaaggcggcgacctccgcgggccagcgggtgaccccggccgagatcggccggagcgtcgcgaagatcctcgcgaaccgcgaggtccgcgcgacgctcgacgcgatccgcgccgccggcggcgaggccctctacgtccctgtcgacgtgaacgacgcgcgggcggtggccgcggcgctcgacggcgtgcgcggcgccctcggccccgtcacggcgatcgtccacggcgccggcgtgctcgccgacaagctcgtcgccgagaagacggtcgagcagttcgagcgcgtgttcagcacgaaggtcgacggcctccgggccctgctcggcgcgacagcgggcgacccgctcaaggcgatcgtcctcttcagctcgatcgccgcgcgcggcggcaacaaggggcagtgcgactacgcgatggcgaacgaggtcctgaacaaggtcgcggccgccgaggcagcccgccgcccgggctgccgggtgaagtcgctcggctgggggccctggcaaggcggcatggtgaacgcggcgctcgaggcccacttcgcgcagctcggcgtgccgctcatcccgctcgccgcgggcgcgaagatgctcctcgacgagctgtgcgacgcctcgggtgatcgcggcgcgcgcgggcaaggcggcgccccgcccggcgcggtcgagctcgtgctcggcgcggagccgaaggcgctcgcggcccaaggccacggcggccgggtcgcgctggccgtccgcgcggaccgcgcgacgcacccctacctcggcgatcacgccatcaacggcgtgcccgtggtgcctgtggtgatcgcgctcgagtggttcgcccgcgccgcgcgcgcgtgccggccggatctcgtcgtgaccgagctccgcgacgtgcgggtcctgcgcgggatcaagctcgcggcgtacgagtccggcggcgaggtgttccgcgtcgactgccgcgaggtgagcaacggccacggcgcggtgctcgcggcggagctgcgcgggccgcagggggcgctgcactacgcggcgaccatccagatgcagcagcccgaagggcgcgtggccccgaagggcccggccgcgccggagctcggcccgtggcccgccggcggcgagctgtacgacggccgcacgctcttccacggccgcgacttccaggtgatccggcggctcgacggcgtgagccgcgacgggatcgcggggacggtcgtgggcctccgcgaggccggctgggtggcccagccgtggaagaccgatccggcggcgctcgacggcgggctgcagctcgcgacgctgtggacgcagcacgtgctcggcggcgcggcgctcccgatgtccgtgggcgcgctgcacaccttcgcggaggggccgtccgacggcccgctgcgcgcggtggtgcgcgggcagatcgtggcccgcgatcgcacgaaggccgacatcgcgttcgttgacgaccgcggctcgctcgtcgcggagctgcgcgacgtgcagtacgtcctgcgccccgacacggcgcgcggccaggcgtga

SEQ ID NO: 21 - protein, 795 aa, Sorangium cellulosum
  SOURCE 1..795: /mol_type="protein" /note="This sequence is generated from feature [CDS]:1..2388 placed under sequence number 20" /organism="Sorangium cellulosum"
QVVDHLRASLGPAAVTAGAAPAEPAEEPASTPLGRWTLVEEPAPAAGLAMPGLFDAGTLVITGHDAIGPALVAALAARGIAAEYAPAVPRGARGAVFLGGLRELATADAALAVHREAFLAAQAIAAKPALFVTVQDTGGDFGLAGSDRAWVGGLPGLVKTAALEWPEASCRAIDLERAGRSDGELAEAIASELLSGGVELEIGLRADGRRTTPRSVRQDAQPGPLPLGPSDVVVASGGARGVTAATLIALARASHARFALLGRTALEDEPAACRGADGEAALKAALVKAATSAGQRVTPAEIGRSVAKILANREVRATLDAIRAAGGEALYVPVDVNDARAVAAALDGVRGALGPVTAIVHGAGVLADKLVAEKTVEQFERVFSTKVDGLRALLGATAGDPLKAIVLFSSIAARGGNKGQCDYAMANEVLNKVAAAEAARRPGCRVKSLGWGPWQGGMVNAALEAHFAQLGVPLIPLAAGAKMLLDELCDASGDRGARGQGGAPPGAVELVLGAEPKALAAQGHGGRVALAVRADRATHPYLGDHAINGVPVVPVVIALEWFARAARACRPDLVVTELRDVRVLRGIKLAAYESGGEVFRVDCREVSNGHGAVLAAELRGPQGALHYAATIQMQQPEGRVAPKGPAAPELGPWPAGGELYDGRTLFHGRDFQVIRRLDGVSRDGIAGTVVGLREAGWVAQPWKTDPAALDGGLQLATLWTQHVLGGAALPMSVGALHTFAEGPSDGPLRAVVRGQIVARDRTKADIAFVDDRGSLVAELRDVQYVLRPDTARGQA

SEQ ID NO: 22 - protein, 795 aa, Sorangium cellulosum; identical to SEQ ID NO: 21
  SOURCE 1..795: /mol_type="protein" /organism="Sorangium cellulosum"

SEQ ID NO: 23 - DNA, 3000 bp, Sorangium cellulosum
  source 1..3000: /mol_type="DNA" /organism="Sorangium cellulosum"
  CDS 1..3000: /codon_start=1 /gene="domain IIIa" /transl_table=11
gtgatcgaggccagcgtgttcgagcccatcgcgatcgtcggccgcgggtgcgtcctcccgggcgcgctccaccccgcggccctctgggacaacgtgctcgccggccgggacctcctgtccgccgcgcccgacggccgctggcgcctctcgcgcgagcgcgcgctcgcgcaggaggggccttccgcgcgcggcgcgcgcgacgtgcgcgacgcgaaggaccgcgcgtggagcgaccgcggcggctacgtcaccgggttcgacgagcacttccgccgcgtgctcgcgagcgacccgttcccgcggcggggcgggacgcccgagtcgctgctcgcgctcgacccgctcttccagtgggtgctccacgcgggccgcgaggcgctgcgcgaggcgggccacgagggccggtccgaccgcgcgggcgcggtgctcgggaacctctcgttcccgtcgtcggccatgtcggcgtgggtcgagtcgacgtggctcggcgatctcgccggcgtcccgcgccccgatccgcgcaaccggttcatgtcggggctgcccgcccacctgctggccgacgtgctcggcctcggggccggggcgttcgcgctcgacgccgcgtgcgcgtcgtcgctgtacgcgatcgcgctcgcctgcgagcggctgcaggatcgcgaggccgaccggatgctcgcgggcgcggtgtgccgctcggacgacctcttcatgcacatcgggttctgcgcgctgtcggccatgagccgcaccgggcagagccgcccgttctcgtcggaggccgacggcctggtcccggcggagggcgcggcgttcgttgtcctggagcgcctgtcggacgcggaggccgcgggcaggccgatcctcggcgtgatccgcgggatcggcctgtcgaacgacggccgcggccgcggcctcctggcgccctccgtcgagggccagctgcgcgcgatgcgggccgcgtacgccatggcgggcctcgatccccgcgaggtgtcgctgctcgagtgccacgcgacgggcacgcccctcggcgacgcgaccgagatcgcgaccctcaaggaggtgttcggctcccgcgaggtcccgctcggctcgctcaagtcgaacctcggtcacctcgtcacgacggccggcgcggccgggctcctcaagctgctcggcgccatggcggccggcgtccgcccgccgacgctgcacgccgatccgctgagcgaggcggtggcctcgagccccttccgggtgctgcagcgcgccgagccgtgggaggggcggcggctcgcgggcctgtcggcgttcgggttcggcgggaacaatgcccacctcctcgtggaggcgtacgagccgtcctcgccgaggggccgcgcggcccgcgccgcgccgcaggccgccgcggcggcctcgcgccctgtcgacgccgggcgccccgcgccggcaggccacctggccgtggtggccatgggcctgtgcgtcggtgagctcagcggcgtccgggccttcgcggagccgctcctctcgggccgcggcgcggatccccgccgggcggcggtcgcgctgcccgcggatcggctccggtttccgccgcgcgatctgcagcaggcgctcgcccagcagacgctgctgctcgaggcggcgatcgaggccaccgaggggctcgcgctgccgcgcgatcgcaccgccgtgctgatcggcatgggcgccgacaccgaggtgtgccggtacatgacgcgctggcggctcgccgagacggcgccggcgcggctcggtccgtcggtcgacgtcggcgcgctccaggacgcgatcatccctgcgctgcaggcggcgggcgtcgtcgggaacatgcccaacatcccggcgaaccggctgaacagccagctcgacgtcggtggaccgtcgttcacgatcgcggccgaggagctgtccggcccctgggcgctgcgcgtcgcgtcccgcgccctgcgcgccggcgcggtggacgcggcgatcgtcggcgcggtggatctctcgtgcgagcccgcccacgcggctgcgctcgaggcgctcggcgtccgcctgccccccggcgacgccgccgtggtgctcgtgctcgagcgcctcgacgacgccgtccgggagcggcacccggtcctggccgttgtcgtggacgagccggccgaccctggcctcgtgctgtcgtccacggatctcgcgccgcggttcggccacgcgcacgcggcctcgggcctgctgcacgtggccgccgcggtgctcgcctgccgtcacggccgcaagcccgacggggcgccgtggtccgacgagatccgggtcgccgaggtccgctgcgccggcctcggcggcggctcgctgtcggtccgcatcggggccggcggccccgccgcgccgctcccgccgccgcgatcggcggaggggccgacgctgacgctccccgcccacccgccggcgatcgtcgtgcccggcgcggcctcctgttcatcccccggagactccatggaacctgcgccgcctctgccgtccgctctcgacgacctgccgccgctgtaccccgggcccacggggttctctgccgccgacgcggatcgggcgccgtcctgggacgagccgccgccggtcgggccggcggtcgtcacggccgtcgccgcgagcctcgcagaggagccgccgccggtcggaccggccgtcgtcgcggccgctgccgtggacatcccgggcgacgtgatcgccggcgccgcggcgttcaccgtgcagctggcgcagatccacaaggagtgggcggagcagcaggcccaggtccaccgccggttccttcagatgcggcagcgcgcgctggactcgctcgtgcaggcgtcgtcgggcgcggccgcggtggtggtcgagacccccttggcgcaggtgccccacgccgcgccggtccgtatcgaggggccgcgcctggtcgatgcgccgcgcctggtcgatgcgccgccgctcgcccgcgccgaggcgccgcagctcgctcgcgcc

SEQ ID NO: 24 - protein, 1000 aa, Sorangium cellulosum
  SOURCE 1..1000: /mol_type="protein" /note="This sequence is generated from feature [CDS]:1..3000 placed under sequence number 23" /organism="Sorangium cellulosum"
VIEASVFEPIAIVGRGCVLPGALHPAALWDNVLAGRDLLSAAPDGRWRLSRERALAQEGPSARGARDVRDAKDRAWSDRGGYVTGFDEHFRRVLASDPFPRRGGTPESLLALDPLFQWVLHAGREALREAGHEGRSDRAGAVLGNLSFPSSAMSAWVESTWLGDLAGVPRPDPRNRFMSGLPAHLLADVLGLGAGAFALDAACASSLYAIALACERLQDREADRMLAGAVCRSDDLFMHIGFCALSAMSRTGQSRPFSSEADGLVPAEGAAFVVLERLSDAEAAGRPILGVIRGIGLSNDGRGRGLLAPSVEGQLRAMRAAYAMAGLDPREVSLLECHATGTPLGDATEIATLKEVFGSREVPLGSLKSNLGHLVTTAGAAGLLKLLGAMAAGVRPPTLHADPLSEAVASSPFRVLQRAEPWEGRRLAGLSAFGFGGNNAHLLVEAYEPSSPRGRAARAAPQAAAAASRPVDAGRPAPAGHLAVVAMGLCVGELSGVRAFAEPLLSGRGADPRRAAVALPADRLRFPPRDLQQALAQQTLLLEAAIEATEGLALPRDRTAVLIGMGADTEVCRYMTRWRLAETAPARLGPSVDVGALQDAIIPALQAAGVVGNMPNIPANRLNSQLDVGGPSFTIAAEELSGPWALRVASRALRAGAVDAAIVGAVDLSCEPAHAAALEALGVRLPPGDAAVVLVLERLDDAVRERHPVLAVVVDEPADPGLVLSSTDLAPRFGHAHAASGLLHVAAAVLACRHGRKPDGAPWSDEIRVAEVRCAGLGGGSLSVRIGAGGPAAPLPPPRSAEGPTLTLPAHPPAIVVPGAASCSSPGDSMEPAPPLPSALDDLPPLYPGPTGFSAADADRAPSWDEPPPVGPAVVTAVAASLAEEPPPVGPAVVAAAAVDIPGDVIAGAAAFTVQLAQIHKEWAEQQAQVHRRFLQMRQRALDSLVQASSGAAAVVVETPLAQVPHAAPVRIEGPRLVDAPRLVDAPPLARAEAPQLARA

SEQ ID NO: 25 - protein, 1000 aa, Sorangium cellulosum; identical to SEQ ID NO: 24
  SOURCE 1..1000: /mol_type="protein" /organism="Sorangium cellulosum"

SEQ ID NO: 26 - DNA, 2697 bp, Sorangium cellulosum
  source 1..2697: /mol_type="DNA" /organism="Sorangium cellulosum"
  CDS 1..2697: /codon_start=1 /gene="domain IIIb" /transl_table=11
gagtcgccgcgtgtcgttgaaccgccgcgcgtcgtcgaggccccgcgcccctccgccgcgccgccccctgcgccgcgtccctccgcccagccggtgctctccgcggcgccttccgtcgcgccccgcggcccccggttcagccgcgagcagctcgagcacctcgcctcggggcggatctccgacgtgttcggcccgctcttcgcccggcaggacgcctatcgccgccaggtgcgcatgcccatgccgccgctgctgctcgccgatcgggtcaccgggatcgacgccgagcccggctcgatgaagctcggcacgatgtggaccgagaccgacgtgcggtgggattcctggtacctgcacgacggcgcgatgccggccggcgtcatgatcgagagcggccaggccgacctgctgctcatcagctggctcggcgcggacttcgagaacaagggcgagcgcgtctaccgcctgctcggctgcgagctcaccttctacggcggcctgccgcgcccgggcgacacgctcgtctacgacatccacgtcgacgggcacgcgaagcacggcgacgtccgcctgttcttcttccactacgactgccggatcggcggcgagctgcgcctgaagacgcgcaagggccaggccggcttcttcaccgacgaggagctcgcgagctccggcggcgtgctctgggacgcggacaccgccgagcccgcgacgaccgcccgcctcgatccgccccggatcgcgtgcgggaagtccgcgttcgaccgggccgacctcctcgcgttcgcggccggagacggcgcggcggcgttcggccccggcttcgatcgtctgagcacccacgtcaggacgccgcggatcagcgctccgcccatgctgttcttcgatcgcgtcgacgtgttcgacccggcgggcggcccgtggaagcgcggctatctccgggccacgctgccgatcacgaaggacggctggtacttcgagggccacttcaaggacgacccctgcatgccggggacgctcatgttcgagggctgcctgcaggcgctcgcgttctacatggcggccatgggcttcacggtggacgcggacggcttccgcttcgagcccgtgccggagatcccgtacctgctccgctgccgcggccaggtggtcccggcgagccgcgtgctcacgtacgaggtgttcgtcgaggaggtccacgacggcccgtgcccgacggtgttcgccgacttcctgtgcacggtcgacggcctcaaggcgttccacgcccgccgcgtgggcctgcgcctcagccccgactggccgctgacgagcgcccccgagctgctcgacggccacgtcgagccggtgccggtcgcgcgcgtcccctggtccgagacgggcgcgccgccgccggacggcgcctctgcagacgccggcggcttcccgttcgattaccggagcctgctctcgtgcgcctggggcaggccgtcggacgcgttcggcccgctctaccgcaggttcgacgggggccagcacgtcgcccggctcccggggccgccgtaccacttcatgagccgggtcctgtcggtctcgcgccccatggcggcgatgaaggccggcgccgaggtcgaggtcgagtacgacgtcccggaggacgcgtggtacttcgacgagaacgcgagcctcacgatgccgttcgcggtggtgctcgaggccgcgctccagacgtgcggctggctcgcgagctacgccggctgcgcgctctcgaccgacggcgcgctgtacttccgcaacctcgacggcaagggcacgctgcacgccgaggtcctgccggcgccggcgccggcagtgagcgcgctgcgcacccgatcgcggctcacgaacatgtcccggtcgggcggcatgatcatcctgtcgttccgggtcgagtgcagcctcggcggcgcgcgggtgtacgacctcgacacggtgttcggcttcttcccgaaggccgcgctcgcgacgcagatcgggatcccgccgaggcccgaggaggtcgccgcgctcgatgagccgtccgatttcgaggtcgatctccgcgagcgccccgcgcggtactgcggcggcaagctcgggctcgcgcggccgtcgctgctgatgatcgaccggatcgacggcctgtggcaggccggcggccggaaggggctcggccggctccgcgcgcggcgggacgtgcacgcgtcggagtggttcttcaaggctcatttcctgggcgatccagtgcagccgggctcgctcggcatcgaggcgatgctgcagacgatccagttctggatgctgcaccaggacctccacgcgggcctccgcgacccgcggttcgagcccgtgatgacggggcacgagcactcctggcggtaccggggccaggtgctgccggccagccggcgggtgacggtcgacaccgacatcctcgaggtcggccgcgacgatcgcgggccctacgtcatcgccgagtcctacctctgggtggacggcctgcgcatctacggcgcgacgctcggcgtgcggatcgtcgacggcgcctcgccgcgggcgcggcgcgacgtcggcttcgacccgcgcgcgagcgcgcgccgcctcgcctcgctcccgggcgccgtgggcgggagcccgcgcctgcgcccgcaggagcagcccgcggcgaaggccgcgccggcgccggcgctcgacgacgtc

SEQ ID NO: 27 - protein, 899 aa, Sorangium cellulosum
  SOURCE 1..899: /mol_type="protein" /note="This sequence is generated from feature [CDS]:1..2697 placed under sequence number 26" /organism="Sorangium cellulosum"
ESPRVVEPPRVVEAPRPSAAPPPAPRPSAQPVLSAAPSVAPRGPRFSREQLEHLASGRISDVFGPLFARQDAYRRQVRMPMPPLLLADRVTGIDAEPGSMKLGTMWTETDVRWDSWYLHDGAMPAGVMIESGQADLLLISWLGADFENKGERVYRLLGCELTFYGGLPRPGDTLVYDIHVDGHAKHGDVRLFFFHYDCRIGGELRLKTRKGQAGFFTDEELASSGGVLWDADTAEPATTARLDPPRIACGKSAFDRADLLAFAAGDGAAAFGPGFDRLSTHVRTPRISAPPMLFFDRVDVFDPAGGPWKRGYLRATLPITKDGWYFEGHFKDDPCMPGTLMFEGCLQALAFYMAAMGFTVDADGFRFEPVPEIPYLLRCRGQVVPASRVLTYEVFVEEVHDGPCPTVFADFLCTVDGLKAFHARRVGLRLSPDWPLTSAPELLDGHVEPVPVARVPWSETGAPPPDGASADAGGFPFDYRSLLSCAWGRPSDAFGPLYRRFDGGQHVARLPGPPYHFMSRVLSVSRPMAAMKAGAEVEVEYDVPEDAWYFDENASLTMPFAVVLEAALQTCGWLASYAGCALSTDGALYFRNLDGKGTLHAEVLPAPAPAVSALRTRSRLTNMSRSGGMIILSFRVECSLGGARVYDLDTVFGFFPKAALATQIGIPPRPEEVAALDEPSDFEVDLRERPARYCGGKLGLARPSLLMIDRIDGLWQAGGRKGLGRLRARRDVHASEWFFKAHFLGDPVQPGSLGIEAMLQTIQFWMLHQDLHAGLRDPRFEPVMTGHEHSWRYRGQVLPASRRVTVDTDILEVGRDDRGPYVIAESYLWVDGLRIYGATLGVRIVDGASPRARRDVGFDPRASARRLASLPGAVGGSPRLRPQEQPAAKAAPAPALDDV

SEQ ID NO: 28 - protein, 899 aa, Sorangium cellulosum; identical to SEQ ID NO: 27
  SOURCE 1..899: /mol_type="protein" /organism="Sorangium cellulosum"

SEQ ID NO: 29 - DNA, 2094 bp, Sorangium cellulosum
  source 1..2094: /mol_type="DNA" /organism="Sorangium cellulosum"
  CDS 1..2094: /codon_start=1 /gene="domain IV*" /transl_table=11
gaggaggtgctggacccggacgggtgggtcgcggaccaccgccccacgtggacggtcccggcgctccccgggatgagcatggtcgaccggctggccggcgccgcgttgcgggcgcgcccggggagcgtggtcgtggccgtggaggacgtggtggtgcagcgctggctgcccgtgccggggccggtgcgcgtgaaggccgaggcgaccggatccggcgacgtcctcgacgtccggctgctcgcgtggcgcgaggcatcgaacccggcgctctcgcggttcgagcccgtgtgcaccggccgcgtgcgggtggcccgtgactacccgcccgccccggcgccggagccggcgctcgacgcgccggaggcggacgatccgtacgccgcggggacgctgttccacggccctgcgttccagtacctgaccgcgctccgcctcggcgcgcgcgggtcatcggcggtgctggacccccggaggggctcggtgcccgctgggacgctgcaccagggcatgctcgacgcgctgacccataccatcccgcacgaccggctgtcgctgtgggatccggggtgcccgcccgcccagatcgcgttcccgtcgcgcatcccgtcgctccgcctgtacgggccggcgcccgagtcgccggtgcgcgtggaggtgcgttacgagggccgtgacgatcgcttcgtctcgttccgggtgcaggccatcgcgcaggccggggtcgaggcgggagagcgcgtctggctggagctccggctggtcgaggtgctgctcccgcaggggccgatcggcggcgcgcctcccgggatccgccgggcgttcctgcgcgatcgcgcgccggtcgacctcgctgtctcgcgcgtcgacgcggcgtcgggcgaggcgcgctgcagccccgccgacgtgcgcacgatggactggatgcccggcaccgtggcgcagctctacgccgcgtcgggcgacctcgtcgaggcggcggcggtgaaggatcacgtcgcgcggcgcgcgggcgtgcacccgtcgaccgtgtcgctcgccggcgtctcctcggcgcagccgctcacgcgctggccgttcaccgtggcgcgcgagggctccgaggtcgtggtccgcgacgcgggcccgcccgtgatcgacatcgcgcctgtccgccgctactggggcgcggccatgggcatcggccggtggccggcggaggacctgtacttcgggctcatcgagcggttcatccgccgggtgcacgtcgtcgatcccgaggcgttccgcgccgtgaagggccggagcctgctctacctcggcaaccaccaggtcggcgtggagtcgctgctgttcggcatcgccgtgtccggcctgacggaggtctcgacggtgacgctggccaaggccgagcaccggacgacgtggctcggcacgatgctcgcgcactgcttcgcgtacccaggcgcgcgcgatccgaaggtgatcacgtacttcgatcgcgaggacaaggcgtcgctcgggagcatcatcgccgagctcggggccgagatgcagggggccggcaagggcgtgatggtgcacgtcgagggcacgcggtcgctcgagtgccgcacgccggtgcgcaagatgagcggctcgttcatcgacatggcgctcgcggtgggcgtcccggtggtgccggtgcgcttctccggcgcgctgccgccggagccgctcgagcggcggctcgaattcccgctcggcatgggcgtgcaggacatctggatcggccgcccgctgctgcccgaggagctcgcggggctgacctacaaggatcgcaaggacctcgtgatcagcggcatcaacgggctcggcccgagcaacacggaggagcagccgttccccggggatcccgcgttcgcggcgtcggtggacgcgtgggtggacgaggcgggcgtcgcgcacgaggacgcgacggtcttccgggtgctgcaggcgtgcgccgatccgacgccggagacggcggcgatcctggaggccgcgcgcacggggcggctcgtcgcgcccgacgcgcggcgggcggactggctgcggaagctcgccgcacggctcctcgggaggcggctcggggggtga

SEQ ID NO: 30 - protein, 697 aa, Sorangium cellulosum
  SOURCE 1..697: /mol_type="protein" /note="This sequence is generated from feature [CDS]:1..2094 placed under sequence number 29" /organism="Sorangium cellulosum"
EEVLDPDGWVADHRPTWTVPALPGMSMVDRLAGAALRARPGSVVVAVEDVVVQRWLPVPGPVRVKAEATGSGDVLDVRLLAWREASNPALSRFEPVCTGRVRVARDYPPAPAPEPALDAPEADDPYAAGTLFHGPAFQYLTALRLGARGSSAVLDPRRGSVPAGTLHQGMLDALTHTIPHDRLSLWDPGCPPAQIAFPSRIPSLRLYGPAPESPVRVEVRYEGRDDRFVSFRVQAIAQAGVEAGERVWLELRLVEVLLPQGPIGGAPPGIRRAFLRDRAPVDLAVSRVDAASGEARCSPADVRTMDWMPGTVAQLYAASGDLVEAAAVKDHVARRAGVHPSTVSLAGVSSAQPLTRWPFTVAREGSEVVVRDAGPPVIDIAPVRRYWGAAMGIGRWPAEDLYFGLIERFIRRVHVVDPEAFRAVKGRSLLYLGNHQVGVESLLFGIAVSGLTEVSTVTLAKAEHRTTWLGTMLAHCFAYPGARDPKVITYFDREDKASLGSIIAELGAEMQGAGKGVMVHVEGTRSLECRTPVRKMSGSFIDMALAVGVPVVPVRFSGALPPEPLERRLEFPLGMGVQDIWIGRPLLPEELAGLTYKDRKDLVISGINGLGPSNTEEQPFPGDPAFAASVDAWVDEAGVAHEDATVFRVLQACADPTPETAAILEAARTGRLVAPDARRADWLRKLAARLLGRRLGG

SEQ ID NO: 31 - protein, 697 aa, Sorangium cellulosum; identical to SEQ ID NO: 30
  SOURCE 1..697: /mol_type="protein" /organism="Sorangium cellulosum"

SEQ ID NO: 32 - DNA, 17221 bp, Sorangium cellulosum
  source 1..17221: /mol_type="DNA" /organism="Sorangium cellulosum"
  CDS 1..1650: /codon_start=1 /product="pfa1" /transl_table=1
  CDS 1677..9380: /codon_start=1 /product="pfa2"
  CDS 9377..17221: /codon_start=1 /product="pfa3"
atgattgaggatccgcaggtcatccgcagcgccggcctccagccgatcggcatctggcgcagcgggccctggctccccgcgttcacatcgacagacttgcgggaggccgtctcctgcgtgcgagagccggtgcacgtggtgcgtgagacgccggatggccgcgtcggcgtgtcccggggcggcgctgtcctccgcgaggatcaggtcaatggggtccccacgttcccgctcctcggcacgctgcccgccctgtacccggagtggctcggagaccgctccttcgtcgaggtccacggcctgcgcttcccctacgtggcgggcgcgatggcgaacggcatccacaccacgcggctcacgatcgcgatggccagggcaggcatgatggggttcttcggcgccgcaggcctcgggctgcaccggatcgagcaggcgatcgacgagatctccgcggcgctcggcgcggacggccccacctggggctgcaacctcatccacgctccgaaccagcccaggctggagagcgacacggtggagctctacctgaagaggggagtccggcgggccgaggcggccgcctacatgggcctgaacccgatggtcgtgcggttcgcctacagcggcgtcaagcgcttgcccgacggccgcgtcgaccggaagaaccacctgttcgcgaagatctcgcgcccggaggtggccgcgcgcttcctgtcgcccgcgccggccgagatcctcgatacctgcgttcgcaacgggtggctcacccgcgacgaggcggagctcgcgcggagcctgccggtcgccgaggacatcaccgtggaagcggactccggcggtcacaccgacaaccagcccctcgtcgcgctgttccccgtgatcctcggcgtccgcgacgagctcgcggcgaagtacgggtatcaccggccgatccgcgtcggcgccgccggcggcctctccacgccggagtcgatcgccgccgcgttcgcgctcggggccgcgtacgtgctcacgggctcggtcaaccagtcgtgcatcgagtcgggcctgtccgacgagggcaagaagatgctggcccaggccgatctcccggacgttgtgatgacgccggccgccgacatgttcgagctcggcgtgcaggtccaggtgctcaagcgcggcacgatgttcggtgtccgcgcgcagcggctctacgacctctacgtcgcccacgactccatcgagtcgctgcccacggacgtgcgcgcgcgcatcgagagagagctgttccagatgtcgtgcgacgaggtgtgggcgggctgcgagcggttcttcacggagcgcgacccggcggagctcgagcgcgccgcgcgcgagccgaagcacaagatggcgctgatcttccgctggtatctcggcatgtccagcaagtgggcgatcgccggggatccgaagcgccgcgccgattaccagatctggtgcggcccggccatgggcgcgttcaaccgctgggtcaaggggtcgttcctcgaagacccggcgcgccgcaccgcggtccaggtcgcgcgcaacctgctcgagggcgcggccgtcgtcacgcgcgcgcagcagctccggacgtacggcgtccccgtgccgagcgccgcattccacttcactcctcgcccgctcgcctgagcgcctgatcatctgccgaggtcctcatgcacccttcgtcttcgcgtatcccgtccatcgccgtcgtcggcgtgagcgccatcttccccggctcgctcgacgcgcacggcttctggcgtgacatcctgtccgggacagacctcatcacggatgtcccgagcacccactggctggtcgaggactactatgatcccgacccgtccgccccggacaagacgtatgcgaagcgcggcgcctttctcaaggacgtgccgttcgatccgctcgagtggggcgtcccgccctcgatcgtgccggcgacggacacgacgcagctgctcgcgctgatcgtggcgaagcgggtcctcgaggacgcggcgcaggggcagttcgaggcgatgaaccgcgagcggatgagcgtgatcctcggcgtcacctccgcgcaggagctgctcgcgtcgatggtgagccggatccagcggccggtgtgggcgaaggcgctccgggacctcgggtatccggaggacgaggtgaagcgcgcctgcgacaagatcgcaggcaactacgtgccgtggcaggagtcgagctttccgggcctgctcgggaacgtggtggccgggcgcatcgcgaaccggctcgacctcggcgggacgaactgcgtgaccgacgcggcgtgcgcgtcgtcgctgtcggcgatgtcgatggcgatcaacgagctggcgctcgggcagtccgatctcgtgatcgcgggcggctgcgacacgatgaacgacgcgttcatgtacatgtgcttcagcaagacgcccgcgctgtccaagtcgggcgactgcaggccgttctccgacaaggccgacgggacgctgctcggcgaggggatcgggatggtggcgctcaagcggctcgacgacgccgagcgcgacggggaccgggtctacgcggtgatccgcgggatcggctcgtcctcggacgggcggagcaagagcgtgtacgcgccggtgccggaagggcaggcgaaggcgatccgccggacgtacgccgcggccgggtacggccccgagaccgtggagctgatggaggcgcacggcaccgggacgaaggccggcgacgcggccgagttcgagggcctgcgcgcgatgttcgacgcgtcggggcgcgctgaccgccagtggtgcgcgctcggcagcgtgaagtcgcagatcggccacaccaaggcggcggccggcgcggccggcctgttcaaggcgatcatggcgctgcaccacaaggtgctcccgccgaccatcaaggtcgacaagccgaaccccaagctggagatagaaaagaccgctttctatctcaacacccaggcgcggccgtggatccggccgggggaccacccgcggcgggcgtcggtgagctcgttcggcttcggcggctcgaacttccacgtggcgctggaggagtacacgggcccggcgccgaaggcgtggcgggtgcgggccctgccggcggagctgttcctcctgtcggcggacacgccggcggcgctcgcggatcgcgcgcgggcgctggcgaaggaggcggaggtgccggagatcctgcgcttcctggcgcgggagtcggtgctctcgttcgacgcgtccaggccggcgcggctcgggctgtgcgcgacggacgaggcggatctcaggaagaagctcgagcaggtcgcggcgcacctcgcggcgaggccggagcaggcgctctcggcgccgctcgtgcactgcgcgagcggggaggcgccggggcgggtggcgttcctgttcccggggcaggggagccagtacgtcgggatgggcgcggacgcgctcatgacgttcgacccggcccgcgcggcctgggacgcggcggcgggcgtcgcgatcgcggacgcgccgctgcacgaggtggtgttcccgcggccggtgttctcggacgaggaccgggcggcgcaggaggcgcggctccgcgagacgcggtgggcgcagccggcgatcggcgcgacgagcctctcgcacctcgcgctgctcgcggcgctcggggtgcgggccgaggcgttcgcgggccacagcttcggcgagatcacggcgctgcacgcggccggggcgctgtccgcggcggacctcctgcgcgtggcgcggcggcgcggcgagctgatgggcgcggcgtcgtcggagcggggcgcgatgatcgcggtcccgcgggggatcgacgaggtgcgggcgctcggcctcggcggcgtggtgatcgcgaaccacaacggcccgaagcaggtggtgctgtcgggctcggtcgcggcgatcgaggccgcggaggagcggctgaagggcgtcgggatccaggcgcggcgcctcgacgtggccgcggcgttccactcgccgctcgtggcggaggcgagcgcgccgctccgcgagttcctggcgggcatcgcggtcgaggcgccggcggcgcccgtgtacagcaacgcggagatcgagccgtacgcgggcggcggcgacgcggcgcgcgaccggctggcgcggcagctcgcggagcctgtgcggttcgtcgaggagatcgagcggatgtacgcggacggcgtgcgcacgttcgtcgaggtcgggccgggctcggtgttgtcgaacctggtcggcgacatcctgagcggtcggccgcaccgggcggtggcgctcgaccgcaagggcaagcacggcgtgacgagcctgctcgaggcggtggcgcggctcgccgtggccggggtgccgctggacacgcgggtcctctgggaaggcttcgcggcgccgagcgatccgcgggcgctgccgaagccgaagctggcgctgcagatcaacgggagcaactacggcaagccgtacccgccgcaggggggcgcgaaggcgctgccggcggcgagcccgccgcgggcggcgcagaagccggcgccggaggcggcgcgggcggtggcgagcgcgccgcggccggtggcgagcgcgtcgcaggcggcagtgagcacgtcgcggccggtggtgagcgcgtcgcagccggcagtgagcgcgtcgcaggcggcagtgagcgcgtccgcgccggtggtgagcgcgtcgcaggcggcagtgagcgcgtcgcggctggcagtgagcgcgtcgcagccggcagtgagcgcgtcgcagccggtggtgagcgcgtccgcgcctgcgctggcgagcgcgtccgcgcctgtggtgagcgcgccgcggccggcagtgagctcgtcgacgcccgtggtgagcgcgtcgcggccgacggcgagcgcgtcgtggctggccgcgtaccaggaggcgcagcgcgcgacggcggaagcccacagcgtgtaccagcggacgatggccgagagccacatcgccttccttcaggccgccgaggcgtccttcgcagggcttgccgcgctggcgaccggcgctccgtaccccgtcgctccaacgacggtgtccgaggtacggcctgctccggttctcctcgctccggtgcatgtggggcctgtctcggaggcgtccctacggctttcggcggcgccgaccgcgcgctccggcgagggcaggagcaacgtggccctggacggcccgaacggcgcgggcggggagctccacacggctgtcgcgctgccggcgcaggcggcgcctgccgtggcagcgaaggtggccgttgcagcgcccgccgcgacagcaaaagcggccaccgcggcgccagctgcgcctgtgaaggcggcagccgctgcgcccgcggtggcagtgtccacggccgtcaccgcgcctgccgccgtggcgacgcaggcggcggtcgccgctgcgccgcgcgtcgatatcgagcgcttggtgctcgacgtggtcgcggacaagacggggtaccccgtctccatgctggggctgcagatggagctggagagcgatctcggcatcgacagcatcaagcgggtggagatcctgtcctcggtccgtgaccggacgccggggctgtcggaggtcgacgcctcggccctggcgcagctgcgcacgctggggcaggtcgtcgaccacctccgcgcctcgctgccggccgccgggccggccgccagcgccagtcccgctgtcgccgcgcccgccgcgaaggcatctgccgtcgcggcgcccgcggccgcttccgtcggggcgcctggcgcggccgaggtggagcgtgtggtgatggcggtcgtcgcggagacgacgggctatccggcggagatgctcgggctgcagatggagctggagagcgacctcggcatcgacagcatcaagcgggtggagatcctgtcggcggtccgtgaccggacgcccgggctgtcggaggtcgacgcgtcggcgctggcgcagctgcgcacgctggggcaggtcgtcgatcacctccgcgcctcgctgccggccgccgggccggcagcgagcgccagtccggctgccgtcgcgcccgccgcgaaggcgtcttccgtcacggtgcctaccgtcgcttccagcgccgcgccaggcgcggccgaggtggagcgagtcgtgatggcggtcgtcgcggagacgacgggctacccggcggagatgctcgggctgcagatggagctggagagcgacctcggcatcgacagcatcaagcgggtggagatcctgtcggcggtccgcgaccggacgccggggctgtcggaggtcgacgcgtcggcgctggcgcagctgcgcacgctggggcaggtcgtcgatcacctccgcgcctcgctgccggccgccagcgccagtccggctgtcgccgcgtccgccgcgaaggcgcctgccgtcgcggcgcctggcgccgcttccggcgcggcgcctggcgcggccgaggtggagcgagtcgtgatggcggtcgtcgcggagacgacgggctacccggcagagatgctggggctgcagatggagctggagagcgacctcggcatcgacagcatcaagcgggtggagatcctgtcggcggtccgcgaccggacgcccgggctcgcggaggtcgacgcctcggcgctggcgcagctgcgcacgctggggcaggtcgtcgaccacctccgcgcctcgctgcctgccgccagcgccagcccggcagtcgtcgcgcccgccgccacggtgcctgccatcgcagcgcccgccgttgctttcgcatcggcgcccgcggcggccgaggtggagcgagtggtgatggcggtcgtcgcggagacgacgggctacccggcggagatgctcgggctgcagatggagctggagagcgatctcggcatcgacagcatcaagcgggtggagatcctgtcggcggtccgcgaccggacgcccgggctcgcggaggtcgacgcctcggcgctggcgcagctgcgcacgctggggcaggtcgtcgaccacctccgcgcgagcctcggttccgccgctgtcaccgccggcgctgcgccggcggagcccgccgaggagccggcctccgcgcccctcggccggtggacgctcgtcgaggagccggcgcccgcggccggcctcgcgatgcccggcctcttcgacgcaggcaccatcgtggtcaccggccacgacgcgatcggccccgcgctcgtcgcggccctcgcggcgcgcgggatcgccgccgagtacgcccccgccgtgccccgcggcgcgcgcggcgccgtgttcctcggcggcctgcgcgagctggccacggccgacgaggcgctcgccgtccaccgcgaggcgttcctcgctgcccaggcgatcgcggcgaagccggccctgttcgtcacggtccaggacaccggcggcgacttcggcctcgcgggctcggaccgcgcctgggtcggcgggctgccgggcctcgtgaagaccgcggcgctggagtgggccgaggcgtcctgccgcgcgatcgacctcgagcgcggcggccgccccgccgccgagctcgcggaggccatcgcctcggagctcctgtccggcggcgtcgagctcgagatcggcctgcgcgcggacggccggcgcaccgcgccgcgaagcgtccggcaggacgcgcagcccgggccgctccccctcgggccgtccgacgtggtcgtggcgagcggcggcgcccgcggcgtcaccgcggcgacgctgatcgcgctcgccagggccagccgcgcgcggttcgcgctgctcggccgcaccgcgctcgaggacgagccggccgcctgccgcggcgccgacggcgaggccgcgctcaaggcggcgctcgtcaaggcggcgacctccgcgggccagcgggtgaccccggcggagatcggcaggagcgtggcgaagatcctcgcgaaccgcgaggtccgcgcgacgctcgacgcgatccgcgccgccggcggcgaggccctctacgtcccggccgacgtgaacgacgcgcgggcggtggccgcggcgctcgacggcgtgcgccgcgccctcggccccgtcacggcgatcgtccacggcgcgggcgtgctcgccgacaagctcgtcgccgagaagacggtcgagcagttcgagcgcgtgttcagcacgaaggtcgacggcctccgggccctgctcggcgcgaccgcgagcgacccgctcaaggcgatcgtcctcttcagctcgatcgccgcgcgcggcggcaacaaggggcagtgcgactacgcgatggcgaacgaggtcctgaacaaggtcgcggccgccgaggcagcccgccgccccggctgccgggtgaagtcgctcggctggggcccctggcaaggcggcatggtgaacgcggcgctcgaggcccacttcgcgcagctcggcgtgccgctcatcccgctcgccgcgggcgcgaagatgctcctcgacgagctgtgcgacgcctcaggcgatcgcggcgatcgcggcgcgcgcgggcaaggcggcgccccgcccggcgcggtcgagctcgtgctcggcgcggagccgaaggcgctcgcggcccagggccagggcggccgggtcgcgctggccgtccgcgcggaccgcgcgacgcacccctacctcggcgatcacgccatcaacggcgtccccgtggtgccggtggtgatcgcgctcgagtggttcgcccgcgccgcgcgcgcgtgccggccggatctcgtcgtcaccgagctccgcgacgtgcgggtcctgcgcgggatcaagctcgccgcgtacgagtccggcggcgaggtgttccgcgtcgactgccgcgaggtgagcaacggccacggcgcggtgctcgcggcggagctgcgcgggccgcagggggcgctgcactacgcggcgaccatccagatgcagccgcccgaagggcgcgtggccccgaagggcccggccgcgccggagctcggcccgtggccctccggcggcgagctgtacgacggccgcacgctcttccacggccgcgacttccaggtgatccggcggctcgacggcgtgagccgcgacgggatcgcggggacggtcgtgggcctccgcgaggccggctgggtggcccagccgtggaagaccgatccggcggcgctcgacggcgggctgcagctcgcgacgctgtggacgcagcacgtgctcggcggcgcggcgctcccgatgtccgtgggcgcgctgcacaccttcgccgaggggccgtccgacggcccgctgcgcgcggtggtgcgcgggcagatcgtggcccgcgatcgcacgaaggccgacatcgcgttcgtcgacgaccgcggctcgctcgtcgcggagctgcgcgacgtgcagtacgtcctgcgccccgacacggcgcgcgggcaggcgtgatcgaggccagcgtgttcgagcccatcgccatcgtcggccgcgggtgcgtcctcccgggcgcgctccaccccgcggccctctgggacaacgtgctcgccggcagggacctcctgtccgccgcccccgacggccgctggcgcctctcgcgcgagcgcgcgctcgcggggccttccgtgcgcggcgcgcgcgacgtgcgcgacgcgcaggaccgcgcgtggagcgaccgcggcggctacgtcgccgggttcgacgagcacttccgccgcgtgctcgccagggacccgttcccgcggcggggcgggccgcccgagtccctgctcgcgctcgacccgctcttccagtgggtgctccacgcgggccgcgaggcgctgcgcgaggcggggcacgagggccggtccgaccgcgcgggcgcggtgttcgggaacctctcgttcccgtcgtcggcgatgtcggcgtgggtcgagtcgacgtggctcggcgatctcgccggcgtcccgcggcccgatccgcgcaaccggttcatgtcggggctgcccgcccacctgctggccgacgtgctcggcctcggggccggcgcgttcgcgctcgacgccgcgtgcgcgtcgtcgctgtacgcgatcgcgctcgcctgcgagcggctgcacgatcgcgaggccgaccggatgctcgcaggcgcggtgtgccgctcggacgatctcttcatccacatcgggttctgcgcgctgtcggccatgagccgcaccgggcagagccgcccgttctcgtcggaggccgacggcctggtcccggcggagggcgcggcgttcgtggtcctggagcgcctgtcggacgcggaggccgcgggcaggccgatcctcggcgtgatccgcggggtcggcctgtcgaacgacggccgcggccgcggcctcctcgcgcccgccgtcgagggccagctgcgcgcgatgcgggccgcgtatgcgacggccggcctcgatcctcgcgaggtgtcgctgctcgagtgccacgcgacgggcacgcccctcggcgacgcgaccgagatcgcgaccctcaaggaggtgttcggctcccgcgaggtcccgctcggctcgctcaagtcgaacctcggtcacctcgtcacgacggccggcgcggccgggctcctcaagctgctcggcgccatggcggcgggcatccgcccgccgacgctgcacgccgatccgctgagcgaggcggtcgcctcgagccccttccgggtgctgcagcgcgccgagccgtgggaggggcgtcggctcgcgggcctgtcggcgttcgggttcggcgggaacaacgcccacctcctcgtggaggcgtacgagccgtcgtcgccgaggagccgagcggcccacgccgcgccgcaggtcgctgcagcggcctcgcgccctgtcgatgccgcgcgccccgcgccggcaggccacctggccgtggtggccatgggcctgtgcgtcggtgagctcagcggcgtccgggccttcgccgagccgctcctctcgggccgcagcgcagatcctcgccgcgcggccgtcgcgctgcccgcggaccggctccggttcccgccgcgcgatctgcagcaggcgctcgcccagcagacgctgctgctcgaggcggcgatcgaggccaccgaggggctcgcgctgccgcgcgatcgcaccgccgtgctcatcggcatgggcgccgacaccgaggtgtgcaggtacatgacgcgctggcggctcgccgagacggcgccggcgcggctcggtccgtcggccgacgtcggcgcgctccaggacgcgatcatccctgcgctgcaggcggcgggcgtcgtcgggaacatgccgaacatcccggcgaaccggctgaacagccagctcgacgtcggtggaccgtcgttcacgatcgccgccgaggagctgtcgggcccctgggcgctgcgcgtcgcgtcccgcgccctgcgcgccggcgcggtcgacgcggcgatcgtcggcgcggtggatctctcgtgcgagcccgcccacgcggccgcgctcgaggcgctcggcgtccacctgccccccggcgacgccgccgtggtgctcgtgctcgagcgcctcgacgacgccgtccgggagcggcacccggtcctggcggtggtcgtggacgagccgggcgaccctggcctcgtgctgtcgtccacggatctcgcgccgcggttcggccacgcgcacgccgcgtcggggctgctgcacgtggccgccgcggtgctcgcgtgccgtcacggccgcaggctcgacggggcgccgtggtccgacgagatccgggtcgccgaggtccgctgcgccggcctcggcggcggctcgctgtcggtccgcatcggggccggcggccctgccgcgccgctcccgccgccgcgatcggcggaggggccgatgctcacgctccccgcccacccgccggcgatcgtcgtgcccggcgcggcctcctgttcatcccccggagactccatggaacctgcgccgcctctgccgtccgctctcgacgacctgccgccgctgtaccccgggcccacggggttctctgccgccgacgcggagcgggcgccgtcctgggacgagccggcggcggtcgagccggcggtcgtcgcggccgtcgccgcgagcctggcagaggagccgccgccggtcggaccggcggtcgtcgcggccgctgccgtggatatcccgggcgacgtgatcgccggcgccgcggcgttcaccgtgcagcttgcgcagatccacaaggagtgggcggagcagcaggcccaggtccaccatcggttccttcagatgcggcagcgcgcgctgcactcgctcgtgcaggcgtcgtcgggcgcggccgcggtggtggtcgaggcccccttggcgcaggcgccccacgccgcgccggtccgtaccgaggccccgcgtccggtcgagtcgccgcctctcgcgcgcatcgaggcgctgcgccctgccgctgcgccgcagccgatcgaggcgccgcgtctcgtccgcgccgaaccgccgcagcctgcccgcgccgagccgccgcgctcgttcgagccgcgtgtcgtcgagccgcgcgtcgtcgagccgccgcgccccgccgccgcgccgcctgcgccgcgccccgccgcccagccggagctccccgcggcgtcttccctcgcgccccgcggcccccggttcagccgcgagcagctcgagcacctcgcctcgggccggatctccgacgtgttcggcccgctcttcgcccggcaggacgcctatcgacgccaggtacgcatgcccatgccgccgctcctgctggccgatcgggtcaccgggatcgacgccgagcccggctcgatgaagctcggcacgatgtggaccgagaccgacgtgcggtgggattcctggtacctgcacgacggcgcgatgccggccggcgtcatgatcgagagcggccaggccgacctgctgctcatcagctggctcggcgcggacttcgagaacaagggcgagcgcgtctaccgcctgctcggctgcgagctcaccttctacggcggcctgccgcgcccgggcgacacgctcgtctacgacatccacgtcgacgggcacgcgaagcacggcgacgtccgcctgttcttcttccactacgactgccgcatcggcggcgagctgcgcctgaagacgcgcaagggccaggcaggcttcttcaccgacgaggagctcgcgagctccggcggcgtcctctgggacgcggacaccgccgagcatgcgacgaccgcccgcctcgatccgccccggatcgcgtgccagaagtccgcgttcgaccgggccgacctcctcgcgttcgcggccggcgacggcgcggcggcgttcggccccgccttcgatcgtttgagcacccacgtcaggacgccgcggatcagcgcgccgccgatgctgttcttcgatcgcgtcgacgtgttcgacccggcgggcggcccgtggaagcgcggctatctccgggccacgctgccgatcacgaaggacggctggtatttcgagggccacttcaaggacgacccctgcatgccggggacgctcatgttcgagggctgcctgcaggcgctcgcgttctacatggcggccatgggcttcacggtggacgcggacggcttccgcttcgagcccgtgccggagatcccctacctgctccgctgccgcggccaggtggtcccgacgagccgcgtgctcacctacgaggtgttcatcgaggaggtccacgacggcccgtgcccgacggtgttcgccgacttcctgtgtacggtcgacggcctcaaggcgttccacgcccgccgcgtgggcctgcgcctcagccccgactggccgctgacgagcgcgcccgagctgctcgacggtcacgtcgagccggtgccggtcgcgcgtgtcccctggtccgagacgggcgcgcctccgccggacggcgccgctgcagacgcgggcggcttcccgttcgattaccggagcctgctctcgtgcgcctggggcaggccgtcggacgcgttcgggccgctctaccgcaggttcgacgcgggacagcacgtcgcccggctcccggggccgccgtaccatttcatgagccgggtcctgtcggtctcgcgccccatggcggcgatgaaggccggcgccgaggtcgaggtcgagtacgacgtcccggaggacgcgtggtacttcgacgagaacgcgagcctcacgatgccgttcgcggtggtgctcgaggccgcgctccagacgtgcggctggctcgcgagctacgccggctgcgcgctctcgaccgacggcgcgctgtacttccgcaacctcgacggcaagggcacgctgcacgccgaggtccttccggcgccggcgccggcagtgagcgcgctgcgcaccaggtcgcggctcacgaacatgtcccggtcgggcggcatgatcatcctctcgttccgggtcgagtgcagcctcggcggcgcgcgggtgtacgagctcgacacggtgttcggcttcttcccgaaggccgcgctcgcgacgcagatcgggatcccgccgaggcccgaggaggtcgccgcgctcgatgagccgtccgatttcgaggtcgatctccgcgagcgccccgcgcggtactgcggcggcaagctcgggctcgcgcggccgtcgctgctgatgatcgaccggatcgacggcctgtggcaggccggcggccggaaggggctcggccggctccgcgcgcggcgggacgtccacgcgtcggagtggttcttcaaggcccatttcctgggcgatcccgtgcagccaggctcgctcggcatcgaggcgatgctgcagacgatccagttctggatgctgcaccaggacctccacgcgggcctgcgcgatccgcggttcgagcccgtgatgacggggcacgagcactcctggcggtaccggggccaggtgctgccggccagccgacgggtgacggtcgacaccgacatcctcgaggtcggccgcgacgaccgcgggccctacgtcatcgccgagtcctacctctgggtggacggcctgcgcatctacggcgcgacgctcggcgtgaggatcgtcgacggcgcctcgtcccgagcgcggcgcgacgtcggcttcgacccgcgcgcgagcgcgcgccgcctcgcgtcgctccccggcgccgtaggcgggagcccgcgcctgcgcccgcaggagccgcccgcggcgaaggccgcgccggcggcgctcgacgacgctgaagaggtgctggacccggacgggtgggtggcggaccatcgccccacgtggacgctcccggcgctccccgggatgagcatggtcgaccggctggccggcgcagcgttgcgggcgcgcccggggagcgtggtcgtggccgtggaggacgtggtggtgcagcgctggctgcccgtgccggggccggtgcgcgtcaaggccgaggcgaccggctcgggcgacgtcctcgatgtccggctgctcgcgtggcgcgaggcatcgaacccggcgctctcgcggttcgagcccgtgtgcaccggccgcgttcgggtggcccgtgactacccgcccgccccggcgccggagccggcgctcgacgcgcctgaggcggacgatccgtacgcggcggggacgctgttccacggccctgcgttccagtacctgacctcgctcaggctcggcgcgcgcggctcgtcggcggtgctggacccccggaggggctcggtgcccccagggacgctgcaccagggcatgctcgacgcgctgacccacaccatcccgcacgatcggctgtcgctgtgggatccagggtgcccgcccgcccagatcgcgttcccgtcgcgcatcccgtcgctccgcgtgtacgggccggcgcccgggtcgccggtgcgcgtggaggtgcgttacgagggccgtgacgatcgcttcgtctcgttccgggtgcaggccatcgcgcaggccggggccgaggtcggggccgcggcgggagagcgcgtctggctggagctccggcttgtcgaggtgctgctcccgcaggggccgatcggcggcgcgccgcccgggatccgccgggcgttcctgcgcgatcgcgcgccggtcgacctcgccgtctcgcgcgtcgacgcggcgtcgggcgaggcgcgctgcagccccgccgacgtgcgcacgatggactggatgcccggcaccgtggcgcagctctacgccgcgtcgggcgacctcgtcgaggcggcggccgtgaaggatcacgtcgcgcggcgcgcgggcgtgcacccgtcgaccgtgtccctcgccggcgtctcgtcggcgcagccgctgacgcgctggccgttcaccgtggcgcgcgagggctccgaggtcgtggtccgcgacgcgggcccgcccgtgatcgacatcgcgccggtccgccgctactggggcgcggccatgggcatcggccggtggccggcggaggacctctacttcgggctcatcgagcggttcatccgccgggtgcacgtcgtcgatcccgcggcgttccgcgccgtgaagggccggagcctgctctacctcggcaaccaccaggtcggcgtggagtcgctgctgttcggcatcgccgtgtccggcctgacggaggtctcgacggtcacgctggccaaggccgagcaccggacgacgtggctcggcacgatgctggcgcactgcttcgcgtatcctggcgcgcgcgatccgaaggtgatcacgtacttcgatcgcgaggacaaggcgtcgctcgggaccatcatcgccgagctcggggccgagatgcagggggccggcaagggcgtgatggtgcacgtcgagggcacgcgatcgctcgagtgccgcacgccggtgcgcaagatgagcggctcgttcatcgacatggcgctcgcggtgggcgtcccggtggtgcctgtgcgcttctccggcgcgctgccgccggagccgctcgagcggcggctcgagttcccgctcggcatgggcgtgcaggacatctggatcggccgcccgctgctgcccgaggagctcgcggggctgacctacaaggaccgcaaggacctcgtgatcagcggcatcaacgggctcggcccgagcaacgcggtcgagcagccgttccccggggatcctgcgttcgcggcgtcggtggacgcctgggtggaggaggcgggcgtcgcgcacgaggacgcgacggtcttccgggtgctgcaggcgtgcgccgacccgacgccggagacggccgcgatcctggaggccgcgcgcacggggcggctcgtcgcgcccgacgcgcggcgggcggactggctgcggaagctcgcggcgcggctcctcgggaggcggctcggggggtga

SEQ ID NO: 33 - protein, 549 aa, Sorangium cellulosum
  SOURCE 1..549: /mol_type="protein" /note="This sequence is generated from feature [CDS]:1..1650 placed under sequence number 32" /organism="Sorangium cellulosum"
MIEDPQVIRSAGLQPIGIWRSGPWLPAFTSTDLREAVSCVREPVHVVRETPDGRVGVSRGGAVLREDQVNGVPTFPLLGTLPALYPEWLGDRSFVEVHGLRFPYVAGAMANGIHTTRLTIAMARAGMMGFFGAAGLGLHRIEQAIDEISAALGADGPTWGCNLIHAPNQPRLESDTVELYLKRGVRRAEAAAYMGLNPMVVRFAYSGVKRLPDGRVDRKNHLFAKISRPEVAARFLSPAPAEILDTCVRNGWLTRDEAELARSLPVAEDITVEADSGGHTDNQPLVALFPVILGVRDELAAKYGYHRPIRVGAAGGLSTPESIAAAFALGAAYVLTGSVNQSCIESGLSDEGKKMLAQADLPDVVMTPAADMFELGVQVQVLKRGTMFGVRAQRLYDLYVAHDSIESLPTDVRARIERELFQMSCDEVWAGCERFFTERDPAELERAAREPKHKMALIFRWYLGMSSKWAIAGDPKRRADYQIWCGPAMGAFNRWVKGSFLEDPARRTAVQVARNLLEGAAVVTRAQQLRTYGVPVPSAAFHFTPRPLA

SEQ ID NO: 34 - protein, 2567 aa, Sorangium cellulosum
  SOURCE 1..2567: /mol_type="protein" /note="This sequence is generated from feature [CDS]:1677..9380 placed under sequence number 32" /organism="Sorangium cellulosum"
MHPSSSRIPSIAVVGVSAIFPGSLDAHGFWRDILSGTDLITDVPSTHWLVEDYYDPDPSAPDKTYAKRGAFLKDVPFDPLEWGVPPSIVPATDTTQLLALIVAKRVLEDAAQGQFEAMNRERMSVILGVTSAQELLASMVSRIQRPVWAKALRDLGYPEDEVKRACDKIAGNYVPWQESSFPGLLGNVVAGRIANRLDLGGTNCVTDAACASSLSAMSMAINELALGQSDLVIAGGCDTMNDAFMYMCFSKTPALSKSGDCRPFSDKADGTLLGEGIGMVALKRLDDAERDGDRVYAVIRGIGSSSDGRSKSVYAPVPEGQAKAIRRTYAAAGYGPETVELMEAHGTGTKAGDAAEFEGLRAMFDASGRADRQWCALGSVKSQIGHTKAAAGAAGLFKAIMALHHKVLPPTIKVDKPNPKLEIEKTAFYLNTQARPWIRPGDHPRRASVSSFGFGGSNFHVALEEYTGPAPKAWRVRALPAELFLLSADTPAALADRARALAKEAEVPEILRFLARESVLSFDASRPARLGLCATDEADLRKKLEQVAAHLAARPEQALSAPLVHCASGEAPGRVAFLFPGQGSQYVGMGADALMTFDPARAAWDAAAGVAIADAPLHEVVFPRPVFSDEDRAAQEARLRETRWAQPAIGATSLSHLALLAALGVRAEAFAGHSFGEITALHAAGALSAADLLRVARRRGELMGAASSERGAMIAVPRGIDEVRALGLGGVVIANHNGPKQVVLSGSVAAIEAAEERLKGVGIQARRLDVAAAFHSPLVAEASAPLREFLAGIAVEAPAAPVYSNAEIEPYAGGGDAARDRLARQLAEPVRFVEEIERMYADGVRTFVEVGPGSVLSNLVGDILSGRPHRAVALDRKGKHGVTSLLEAVARLAVAGVPLDTRVLWEGFAAPSDPRALPKPKLALQINGSNYGKPYPPQGGAKALPAASPPRAAQKPAPEAARAVASAPRPVASASQAAVSTSRPVVSASQPAVSASQAAVSASAPVVSASQAAVSASRLAVSASQPAVSASQPVVSASAPALASASAPVVSAPRPAVSSSTPVVSASRPTASASWLAAYQEAQRATAEAHSVYQRTMAESHIAFLQAAEASFAGLAALATGAPYPVAPTTVSEVRPAPVLLAPVHVGPVSEASLRLSAAPTARSGEGRSNVALDGPNGAGGELHTAVALPAQAAPAVAAKVAVAAPAATAKAATAAPAAPVKAAAAAPAVAVSTAVTAPAAVATQAAVAAAPRVDIERLVLDVVADKTGYPVSMLGLQMELESDLGIDSIKRVEILSSVRDRTPGLSEVDASALAQLRTLGQVVDHLRASLPAAGPAASASPAVAAPAAKASAVAAPAAASVGAPGAAEVERVVMAVVAETTGYPAEMLGLQMELESDLGIDSIKRVEILSAVRDRTPGLSEVDASALAQLRTLGQVVDHLRASLPAAGPAASASPAAVAPAAKASSVTVPTVASSAAPGAAEVERVVMAVVAETTGYPAEMLGLQMELESDLGIDSIKRVEILSAVRDRTPGLSEVDASALAQLRTLGQVVDHLRASLPAASASPAVAASAAKAPAVAAPGAASGAAPGAAEVERVVMAVVAETTGYPAEMLGLQMELESDLGIDSIKRVEILSAVRDRTPGLAEVDASALAQLRTLGQVVDHLRASLPAASASPAVVAPAATVPAIAAPAVAFASAPAAAEVERVVMAVVAETTGYPAEMLGLQMELESDLGIDSIKRVEILSAVRDRTPGLAEVDASALAQLRTLGQVVDHLRASLGSAAVTAGAAPAEPAEEPASAPLGRWTLVEEPAPAAGLAMPGLFDAGTIVVTGHDAIGPALVAALAARGIAAEYAPAVPRGARGAVFLGGLRELATADEALAVHREAFLAAQAIAAKPALFVTVQDTGGDFGLAGSDRAWVGGLPGLVKTAALEWAEASCRAIDLERGGRPAAELAEAIASELLSGGVELEIGLRADGRRTAPRSVRQDAQPGPLPLGPSDVVVASGGARGVTAATLIALARASRARFALLGRTALEDEPAACRGADGEAALKAALVKAATSAGQRVTPAEIGRSVAKILANREVRATLDAIRAAGGEALYVPADVNDARAVAAALDGVRRALGPVTAIVHGAGVLADKLVAEKTVEQFERVFSTKVDGLRALLGATASDPLKAIVLFSSIAARGGNKGQCDYAMANEVLNKVAAAEAARRPGCRVKSLGWGPWQGGMVNAALEAHFAQLGVPLIPLAAGAKMLLDELCDASGDRGDRGARGQGGAPPGAVELVLGAEPKALAAQGQGGRVALAVRADRATHPYLGDHAINGVPVVPVVIALEWFARAARACRPDLVVTELRDVRVLRGIKLAAYESGGEVFRVDCREVSNGHGAVLAAELRGPQGALHYAATIQMQPPEGRVAPKGPAAPELGPWPSGGELYDGRTLFHGRDFQVIRRLDGVSRDGIAGTVVGLREAGWVAQPWKTDPAALDGGLQLATLWTQHVLGGAALPMSVGALHTFAEGPSDGPLRAVVRGQIVARDRTKADIAFVDDRGSLVAELRDVQYVLRPDTARGQA

SEQ ID NO: 35 - protein, 2614 aa, Sorangium cellulosum
  SOURCE 1..2614: /mol_type="protein" /note="This sequence is generated from feature [CDS]: 9377..17221 placed under sequence number 32" /organism="Sorangium cellulosum"
VIEASVFEPIAIVGRGCVLPGALHPAALWDNVLAGRDLLSAAPDGRWRLSRERALAGPSVRGARDVRDAQDRAWSDRGGYVAGFDEHFRRVLARDPFPRRGGPPESLLALDPLFQWVLHAGREALREAGHEGRSDRAGAVFGNLSFPSSAMSAWVESTWLGDLAGVPRPDPRNRFMSGLPAHLLADVLGLGAGAFALDAACASSLYAIALACERLHDREADRMLAGAVCRSDDLFIHIGFCALSAMSRTGQSRPFSSEADGLVPAEGAAFVVLERLSDAEAAGRPILGVIRGVGLSNDGRGRGLLAPAVEGQLRAMRAAYATAGLDPREVSLLECHATGTPLGDATEIATLKEVFGSREVPLGSLKSNLGHLVTTAGAAGLLKLLGAMAAGIRPPTLHADPLSEAVASSPFRVLQRAEPWEGRRLAGLSAFGFGGNNAHLLVEAYEPSSPRSRAAHAAPQVAAAASRPVDAARPAPAGHLAVVAMGLCVGELSGVRAFAEPLLSGRSADPRRAAVALPADRLRFPPRDLQQALAQQTLLLEAAIEATEGLALPRDRTAVLIGMGADTEVCRYMTRWRLAETAPARLGPSADVGALQDAIIPALQAAGVVGNMPNIPANRLNSQLDVGGPSFTIAAEELSGPWALRVASRALRAGAVDAAIVGAVDLSCEPAHAAALEALGVHLPPGDAAVVLVLERLDDAVRERHPVLAVVVDEPGDPGLVLSSTDLAPRFGHAHAASGLLHVAAAVLACRHGRRLDGAPWSDEIRVAEVRCAGLGGGSLSVRIGAGGPAAPLPPPRSAEGPMLTLPAHPPAIVVPGAASCSSPGDSMEPAPPLPSALDDLPPLYPGPTGFSAADAERAPSWDEPAAVEPAVVAAVAASLAEEPPPVGPAVVAAAAVDIPGDVIAGAAAFTVQLAQIHKEWAEQQAQVHHRFLQMRQRALHSLVQASSGAAAVVVEAPLAQAPHAAPVRTEAPRPVESPPLARIEALRPAAAPQPIEAPRLVRAEPPQPARAEPPRSFEPRVVEPRVVEPPRPAAAPPAPRPAAQPELPAASSLAPRGPRFSREQLEHLASGRISDVFGPLFARQDAYRRQVRMPMPPLLLADRVTGIDAEPGSMKLGTMWTETDVRWDSWYLHDGAMPAGVMIESGQADLLLISWLGADFENKGERVYRLLGCELTFYGGLPRPGDTLVYDIHVDGHAKHGDVRLFFFHYDCRIGGELRLKTRKGQAGFFTDEELASSGGVLWDADTAEHATTARLDPPRIACQKSAFDRADLLAFAAGDGAAAFGPAFDRLSTHVRTPRISAPPMLFFDRVDVFDPAGGPWKRGYLRATLPITKDGWYFEGHFKDDPCMPGTLMFEGCLQALAFYMAAMGFTVDADGFRFEPVPEIPYLLRCRGQVVPTSRVLTYEVFIEEVHDGPCPTVFADFLCTVDGLKAFHARRVGLRLSPDWPLTSAPELLDGHVEPVPVARVPWSETGAPPPDGAAADAGGFPFDYRSLLSCAWGRPSDAFGPLYRRFDAGQHVARLPGPPYHFMSRVLSVSRPMAAMKAGAEVEVEYDVPEDAWYFDENASLTMPFAVVLEAALQTCGWLASYAGCALSTDGALYFRNLDGKGTLHAEVLPAPAPAVSALRTRSRLTNMSRSGGMIILSFRVECSLGGARVYELDTVFGFFPKAALATQIGIPPRPEEVAALDEPSDFEVDLRERPARYCGGKLGLARPSLLMIDRIDGLWQAGGRKGLGRLRARRDVHASEWFFKAHFLGDPVQPGSLGIEAMLQTIQFWMLHQDLHAGLRDPRFEPVMTGHEHSWRYRGQVLPASRRVTVDTDILEVGRDDRGPYVIAESYLWVDGLRIYGATLGVRIVDGASSRARRDVGFDPRASARRLASLPGAVGGSPRLRPQEPPAAKAAPAALDDAEEVLDPDGWVADHRPTWTLPALPGMSMVDRLAGAALRARPGSVVVAVEDVVVQRWLPVPGPVRVKAEATGSGDVLDVRLLAWREASNPALSRFEPVCTGRVRVARDYPPAPAPEPALDAPEADDPYAAGTLFHGPAFQYLTSLRLGARGSSAVLDPRRGSVPPGTLHQGMLDALTHTIPHDRLSLWDPGCPPAQIAFPSRIPSLRVYGPAPGSPVRVEVRYEGRDDRFVSFRVQAIAQAGAEVGAAAGERVWLELRLVEVLLPQGPIGGAPPGIRRAFLRDRAPVDLAVSRVDAASGEARCSPADVRTMDWMPGTVAQLYAASGDLVEAAAVKDHVARRAGVHPSTVSLAGVSSAQPLTRWPFTVAREGSEVVVRDAGPPVIDIAPVRRYWGAAMGIGRWPAEDLYFGLIERFIRRVHVVDPAAFRAVKGRSLLYLGNHQVGVESLLFGIAVSGLTEVSTVTLAKAEHRTTWLGTMLAHCFAYPGARDPKVITYFDREDKASLGTIIAELGAEMQGAGKGVMVHVEGTRSLECRTPVRKMSGSFIDMALAVGVPVVPVRFSGALPPEPLERRLEFPLGMGVQDIWIGRPLLPEELAGLTYKDRKDLVISGINGLGPSNAVEQPFPGDPAFAASVDAWVEEAGVAHEDATVFRVLQACADPTPETAAILEAARTGRLVAPDARRADWLRKLAARLLGRRLGG

SEQ ID NO: 36 - DNA, 1650 bp, Sorangium cellulosum
  source 1..1650: /mol_type="DNA" /organism="Sorangium cellulosum"
  CDS 1..1650: /codon_start=1 /product="pfa1" /transl_table=1
atgattgaggatccgcaggtcatccgcagcgccggcctccagccgatcggcatctggcgcagcgggccctggctccccgcgttcacatcgacagacttgcgggaggccgtctcctgcgtgcgagagccggtgcacgtggtgcgtgagacgccggatggccgcgtcggcgtgtcccggggcggcgctgtcctccgcgaggatcaggtcaatggggtccccacgttcccgctcctcggcacgctgcccgccctgtacccggagtggctcggagaccgctccttcgtcgaggtccacggcctgcgcttcccctacgtggcgggcgcgatggcgaacggcatccacaccacgcggctcacgatcgcgatggccagggcaggcatgatggggttcttcggcgccgcaggcctcgggctgcaccggatcgagcaggcgatcgacgagatctccgcggcgctcggcgcggacggccccacctggggctgcaacctcatccacgctccgaaccagcccaggctggagagcgacacggtggagctctacctgaagaggggagtccggcgggccgaggcggccgcctacatgggcctgaacccgatggtcgtgcggttcgcctacagcggcgtcaagcgcttgcccgacggccgcgtcgaccggaagaaccacctgttcgcgaagatctcgcgcccggaggtggccgcgcgcttcctgtcgcccgcgccggccgagatcctcgatacctgcgttcgcaacgggtggctcacccgcgacgaggcggagctcgcgcggagcctgccggtcgccgaggacatcaccgtggaagcggactccggcggtcacaccgacaaccagcccctcgtcgcgctgttccccgtgatcctcggcgtccgcgacgagctcgcggcgaagtacgggtatcaccggccgatccgcgtcggcgccgccggcggcctctccacgccggagtcgatcgccgccgcgttcgcgctcggggccgcgtacgtgctcacgggctcggtcaaccagtcgtgcatcgagtcgggcctgtccgacgagggcaagaagatgctggcccaggccgatctcccggacgttgtgatgacgccggccgccgacatgttcgagctcggcgtgcaggtccaggtgctcaagcgcggcacgatgttcggtgtccgcgcgcagcggctctacgacctctacgtcgcccacgactccatcgagtcgctgcccacggacgtgcgcgcgcgcatcgagagagagctgttccagatgtcgtgcgacgaggtgtgggcgggctgcgagcggttcttcacggagcgcgacccggcggagctcgagcgcgccgcgcgcgagccgaagcacaagatggcgctgatcttccgctggtatctcggcatgtccagcaagtgggcgatcgccggggatccgaagcgccgcgccgattaccagatctggtgcggcccggccatgggcgcgttcaaccgctgggtcaaggggtcgttcctcgaagacccggcgcgccgcaccgcggtccaggtcgcgcgcaacctgctcgagggcgcggccgtcgtcacgcgcgcgcagcagctccggacgtacggcgtccccgtgccgagcgccgcattccacttcactcctcgcccgctcgcctga

SEQ ID NO: 37 - protein, 549 aa, Sorangium cellulosum; identical to SEQ ID NO: 33
  SOURCE 1..549: /mol_type="protein" /note="This sequence is generated from feature [CDS]: 1..1650 placed under sequence number 36" /organism="Sorangium cellulosum"

SEQ ID NO: 38 - DNA, 7704 bp, Sorangium cellulosum
  source 1..7704: /mol_type="DNA" /organism="Sorangium cellulosum"
  CDS 1..4404: /codon_start=1 /product="pfa2" /transl_table=1
atgcacccttcgtcttcgcgtatcccgtccatcgccgtcgtcggcgtgagcgccatcttccccggctcgctcgacgcgcacggcttctggcgtgacatcctgtccgggacagacctcatcacggatgtcccgagcacccactggctggtcgaggactactatgatcccgacccgtccgccccggacaagacgtatgcgaagcgcggcgcctttctcaaggacgtgccgttcgatccgctcgagtggggcgtcccgccctcgatcgtgccggcgacggacacgacgcagctgctcgcgctgatcgtggcgaagcgggtcctcgaggacgcggcgcaggggcagttcgaggcgatgaaccgcgagcggatgagcgtgatcctcggcgtcacctccgcgcaggagctgctcgcgtcgatggtgagccggatccagcggccggtgtgggcgaaggcgctccgggacctcgggtatccggaggacgaggtgaagcgcgcctgcgacaagatcgcaggcaactacgtgccgtggcaggagtcgagctttccgggcctgctcgggaacgtggtggccgggcgcatcgcgaaccggctcgacctcggcgggacgaactgcgtgaccgacgcggcgtgcgcgtcgtcgctgtcggcgatgtcgatggcgatcaacgagctggcgctcgggcagtccgatctcgtgatcgcgggcggctgcgacacgatgaacgacgcgttcatgtacatgtgcttcagcaagacgcccgcgctgtccaagtcgggcgactgcaggccgttctccgacaaggccgacgggacgctgctcggcgaggggatcgggatggtggcgctcaagcggctcgacgacgccgagcgcgacggggaccgggtctacgcggtgatccgcgggatcggctcgtcctcggacgggcggagcaagagcgtgtacgcgccggtgccggaagggcaggcgaaggcgatccgccggacgtacgccgcggccgggtacggccccgagaccgtggagctgatggaggcgcacggcaccgggacgaaggccggcgacgcggccgagttcgagggcctgcgcgcgatgttcgacgcgtcggggcgcgctgaccgccagtggtgcgcgctcggcagcgtgaagtcgcagatcggccacaccaaggcggcggccggcgcggccggcctgttcaaggcgatcatggcgctgcaccacaaggtgctcccgccgaccatcaaggtcgacaagccgaaccccaagctggagatagaaaagaccgctttctatctcaacacccaggcgcggccgtggatccggccgggggaccacccgcggcgggcgtcggtgagctcgttcggcttcggcggctcgaacttccacgtggcgctggaggagtacacgggcccggcgccgaaggcgtggcgggtgcgggccctgccggcggagctgttcctcctgtcggcggacacgccggcggcgctcgcggatcgcgcgcgggcgctggcgaaggaggcggaggtgccggagatcctgcgcttcctggcgcgggagtcggtgctctcgttcgacgcgtccaggccggcgcggctcgggctgtgcgcgacggacgaggcggatctcaggaagaagctcgagcaggtcgcggcgcacctcgcggcgaggccggagcaggcgctctcggcgccgctcgtgcactgcgcgagcggggaggcgccggggcgggtggcgttcctgttcccggggcaggggagccagtacgtcgggatgggcgcggacgcgctcatgacgttcgacccggcccgcgcggcctgggacgcggcggcgggcgtcgcgatcgcggacgcgccgctgcacgaggtggtgttcccgcggccggtgttctcggacgaggaccgggcggcgcaggaggcgcggctccgcgagacgcggtgggcgcagccggcgatcggcgcgacgagcctctcgcacctcgcgctgctcgcggcgctcggggtgcgggccgaggcgttcgcgggccacagcttcggcgagatcacggcgctgcacgcggccggggcgctgtccgcggcggacctcctgcgcgtggcgcggcggcgcggcgagctgatgggcgcggcgtcgtcggagcggggcgcgatgatcgcggtcccgcgggggatcgacgaggtgcgggcgctcggcctcggcggcgtggtgatcgcgaaccacaacggcccgaagcaggtggtgctgtcgggctcggtcgcggcgatcgaggccgcggaggagcggctgaagggcgtcgggatccaggcgcggcgcctcgacgtggccgcggcgttccactcgccgctcgtggcggaggcgagcgcgccgctccgcgagttcctggcgggcatcgcggtcgaggcgccggcggcgcccgtgtacagcaacgcggagatcgagccgtacgcgggcggcggcgacgcggcgcgcgaccggctggcgcggcagctcgcggagcctgtgcggttcgtcgaggagatcgagcggatgtacgcggacggcgtgcgcacgttcgtcgaggtcgggccgggctcggtgttgtcgaacctggtcggcgacatcctgagcggtcggccgcaccgggcggtggcgctcgaccgcaagggcaagcacggcgtgacgagcctgctcgaggcggtggcgcggctcgccgtggccggggtgccgctggacacgcgggtcctctgggaaggcttcgcggcgccgagcgatccgcgggcgctgccgaagccgaagctggcgctgcagatcaacgggagcaactacggcaagccgtacccgccgcaggggggcgcgaaggcgctgccggcggcgagcccgccgcgggcggcgcagaagccggcgccggaggcggcgcgggcggtggcgagcgcgccgcggccggtggcgagcgcgtcgcaggcggcagtgagcacgtcgcggccggtggtgagcgcgtcgcagccggcagtgagcgcgtcgcaggcggcagtgagcgcgtccgcgccggtggtgagcgcgtcgcaggcggcagtgagcgcgtcgcggctggcagtgagcgcgtcgcagccggcagtgagcgcgtcgcagccggtggtgagcgcgtccgcgcctgcgctggcgagcgcgtccgcgcctgtggtgagcgcgccgcggccggcagtgagctcgtcgacgcccgtggtgagcgcgtcgcggccgacggcgagcgcgtcgtggctggccgcgtaccaggaggcgcagcgcgcgacggcggaagcccacagcgtgtaccagcggacgatggccgagagccacatcgccttccttcaggccgccgaggcgtccttcgcagggcttgccgcgctggcgaccggcgctccgtaccccgtcgctccaacgacggtgtccgaggtacggcctgctccggttctcctcgctccggtgcatgtggggcctgtctcggaggcgtccctacggctttcggcggcgccgaccgcgcgctccggcgagggcaggagcaacgtggccctggacggcccgaacggcgcgggcggggagctccacacggctgtcgcgctgccggcgcaggcggcgcctgccgtggcagcgaaggtggccgttgcagcgcccgccgcgacagcaaaagcggccaccgcggcgccagctgcgcctgtgaaggcggcagccgctgcgcccgcggtggcagtgtccacggccgtcaccgcgcctgccgccgtggcgacgcaggcggcggtcgccgctgcgccgcgcgtcgatatcgagcgcttggtgctcgacgtggtcgcggacaagacggggtaccccgtctccatgctggggctgcagatggagctggagagcgatctcggcatcgacagcatcaagcgggtggagatcctgtcctcggtccgtgaccggacgccggggctgtcggaggtcgacgcctcggccctggcgcagctgcgcacgctggggcaggtcgtcgaccacctccgcgcctcgctgccggccgccgggccggccgccagcgccagtcccgctgtcgccgcgcccgccgcgaaggcatctgccgtcgcggcgcccgcggccgcttccgtcggggcgcctggcgcggccgaggtggagcgtgtggtgatggcggtcgtcgcggagacgacgggctatccggcggagatgctcgggctgcagatggagctggagagcgacctcggcatcgacagcatcaagcgggtggagatcctgtcggcggtccgtgaccggacgcccgggctgtcggaggtcgacgcgtcggcgctggcgcagctgcgcacgctggggcaggtcgtcgatcacctccgcgcctcgctgccggccgccgggccggcagcgagcgccagtccggctgccgtcgcgcccgccgcgaaggcgtcttccgtcacggtgcctaccgtcgcttccagcgccgcgccaggcgcggccgaggtggagcgagtcgtgatggcggtcgtcgcggagacgacgggctacccggcggagatgctcgggctgcagatggagctggagagcgacctcggcatcgacagcatcaagcgggtggagatcctgtcggcggtccgcgaccggacgccggggctgtcggaggtcgacgcgtcggcgctggcgcagctgcgcacgctggggcaggtcgtcgatcacctccgcgcctcgctgccggccgccagcgccagtccggctgtcgccgcgtccgccgcgaaggcgcctgccgtcgcggcgcctggcgccgcttccggcgcggcgcctggcgcggccgaggtggagcgagtcgtgatggcggtcgtcgcggagacgacgggctacccggcagagatgctggggctgcagatggagctggagagcgacctcggcatcgacagcatcaagcgggtggagatcctgtcggcggtccgcgaccggacgcccgggctcgcggaggtcgacgcctcggcgctggcgcagctgcgcacgctggggcaggtcgtcgaccacctccgcgcctcgctgcctgccgccagcgccagcccggcagtcgtcgcgcccgccgccacggtgcctgccatcgcagcgcccgccgttgctttcgcatcggcgcccgcggcggccgaggtggagcgagtggtgatggcggtcgtcgcggagacgacgggctacccggcggagatgctcgggctgcagatggagctggagagcgatctcggcatcgacagcatcaagcgggtggagatcctgtcggcggtccgcgaccggacgcccgggctcgcggaggtcgacgcctcggcgctggcgcagctgcgcacgctggggcaggtcgtcgaccacctccgcgcgagcctcggttccgccgctgtcaccgccggcgctgcgccggcggagcccgccgaggagccggcctccgcgcccctcggccggtggacgctcgtcgaggagccggcgcccgcggccggcctcgcgatgcccggcctcttcgacgcaggcaccatcgtggtcaccggccacgacgcgatcggccccgcgctcgtcgcggccctcgcggcgcgcgggatcgccgccgagtacgcccccgccgtgccccgcggcgcgcgcggcgccgtgttcctcggcggcctgcgcgagctggccacggccgacgaggcgctcgccgtccaccgcgaggcgttcctcgctgcccaggcgatcgcggcgaagccggccctgttcgtcacggtccaggacaccggcggcgacttcggcctcgcgggctcggaccgcgcctgggtcggcgggctgccgggcctcgtgaagaccgcggcgctggagtgggccgaggcgtcctgccgcgcgatcgacctcgagcgcggcggccgccccgccgccgagctcgcggaggccatcgcctcggagctcctgtccggcggcgtcgagctcgagatcggcctgcgcgcggacggccggcgcaccgcgccgcgaagcgtccggcaggacgcgcagcccgggccgctccccctcgggccgtccgacgtggtcgtggcgagcggcggcgcccgcggcgtcaccgcggcgacgctgatcgcgctcgccagggccagccgcgcgcggttcgcgctgctcggccgcaccgcgctcgaggacgagccggccgcctgccgcggcgccgacggcgaggccgcgctcaaggcggcgctcgtcaaggcggcgacctccgcgggccagcgggtgaccccggcggagatcggcaggagcgtggcgaagatcctcgcgaaccgcgaggtccgcgcgacgctcgacgcgatccgcgccgccggcggcgaggccctctacgtcccggccgacgtgaacgacgcgcgggcggtggccgcggcgctcgacggcgtgcgccgcgccctcggccccgtcacggcgatcgtccacggcgcgggcgtgctcgccgacaagctcgtcgccgagaagacggtcgagcagttcgagcgcgtgttcagcacgaaggtcgacggcctccgggccctgctcggcgcgaccgcgagcgacccgctcaaggcgatcgtcctcttcagctcgatcgccgcgcgcggcggcaacaaggggcagtgcgactacgcgatggcgaacgaggtcctgaacaaggtcgcggccgccgaggcagcccgccgccccggctgccgggtgaagtcgctcggctggggcccctggcaaggcggcatggtgaacgcggcgctcgaggcccacttcgcgcagctcggcgtgccgctcatcccgctcgccgcgggcgcgaagatgctcctcgacgagctgtgcgacgcctcaggcgatcgcggcgatcgcggcgcgcgcgggcaaggcggcgccccgcccggcgcggtcgagctcgtgctcggcgcggagccgaaggcgctcgcggcccagggccagggcggccgggtcgcgctggccgtccgcgcggaccgcgcgacgcacccctacctcggcgatcacgccatcaacggcgtccccgtggtgccggtggtgatcgcgctcgagtggttcgcccgcgccgcgcgcgcgtgccggccggatctcgtcgtcaccgagctccgcgacgtgcgggtcctgcgcgggatcaagctcgccgcgtacgagtccggcggcgaggtgttccgcgtcgactgccgcgaggtgagcaacggccacggcgcggtgctcgcggcggagctgcgcgggccgcagggggcgctgcactacgcggcgaccatccagatgcagccgcccgaagggcgcgtggccccgaagggcccggccgcgccggagctcggcccgtggccctccggcggcgagctgtacgacggccgcacgctcttccacggccgcgacttccaggtgatccggcggctcgacggcgtgagccgcgacgggatcgcggggacggtcgtgggcctccgcgaggccggctgggtggcccagccgtggaagaccgatccggcggcgctcgacggcgggctgcagctcgcgacgctgtggacgcagcacgtgctcggcggcgcggcgctcccgatgtccgtgggcgcgctgcacaccttcgccgaggggccgtccgacggcccgctgcgcgcggtggtgcgcgggcagatcgtggcccgcgatcgcacgaaggccgacatcgcgttcgtcgacgaccgcggctcgctcgtcgcggagctgcgcgacgtgcagtacgtcctgcgccccgacacggcgcgcgggcaggcgtga

SEQ ID NO: 39 - protein, 1468 aa, Sorangium cellulosum
  SOURCE 1..1468: /mol_type="protein" /note="This sequence is generated from feature [CDS]: 1..4404 placed under sequence number 38" /organism="Sorangium cellulosum"
MHPSSSRIPSIAVVGVSAIFPGSLDAHGFWRDILSGTDLITDVPSTHWLVEDYYDPDPSAPDKTYAKRGAFLKDVPFDPLEWGVPPSIVPATDTTQLLALIVAKRVLEDAAQGQFEAMNRERMSVILGVTSAQELLASMVSRIQRPVWAKALRDLGYPEDEVKRACDKIAGNYVPWQESSFPGLLGNVVAGRIANRLDLGGTNCVTDAACASSLSAMSMAINELALGQSDLVIAGGCDTMNDAFMYMCFSKTPALSKSGDCRPFSDKADGTLLGEGIGMVALKRLDDAERDGDRVYAVIRGIGSSSDGRSKSVYAPVPEGQAKAIRRTYAAAGYGPETVELMEAHGTGTKAGDAAEFEGLRAMFDASGRADRQWCALGSVKSQIGHTKAAAGAAGLFKAIMALHHKVLPPTIKVDKPNPKLEIEKTAFYLNTQARPWIRPGDHPRRASVSSFGFGGSNFHVALEEYTGPAPKAWRVRALPAELFLLSADTPAALADRARALAKEAEVPEILRFLARESVLSFDASRPARLGLCATDEADLRKKLEQVAAHLAARPEQALSAPLVHCASGEAPGRVAFLFPGQGSQYVGMGADALMTFDPARAAWDAAAGVAIADAPLHEVVFPRPVFSDEDRAAQEARLRETRWAQPAIGATSLSHLALLAALGVRAEAFAGHSFGEITALHAAGALSAADLLRVARRRGELMGAASSERGAMIAVPRGIDEVRALGLGGVVIANHNGPKQVVLSGSVAAIEAAEERLKGVGIQARRLDVAAAFHSPLVAEASAPLREFLAGIAVEAPAAPVYSNAEIEPYAGGGDAARDRLARQLAEPVRFVEEIERMYADGVRTFVEVGPGSVLSNLVGDILSGRPHRAVALDRKGKHGVTSLLEAVARLAVAGVPLDTRVLWEGFAAPSDPRALPKPKLALQINGSNYGKPYPPQGGAKALPAASPPRAAQKPAPEAARAVASAPRPVASASQAAVSTSRPVVSASQPAVSASQAAVSASAPVVSASQAAVSASRLAVSASQPAVSASQPVVSASAPALASASAPVVSAPRPAVSSSTPVVSASRPTASASWLAAYQEAQRATAEAHSVYQRTMAESHIAFLQAAEASFAGLAALATGAPYPVAPTTVSEVRPAPVLLAPVHVGPVSEASLRLSAAPTARSGEGRSNVALDGPNGAGGELHTAVALPAQAAPAVAAKVAVAAPAATAKAATAAPAAPVKAAAAAPAVAVSTAVTAPAAVATQAAVAAAPRVDIERLVLDVVADKTGYPVSMLGLQMELESDLGIDSIKRVEILSSVRDRTPGLSEVDASALAQLRTLGQVVDHLRASLPAAGPAASASPAVAAPAAKASAVAAPAAASVGAPGAAEVERVVMAVVAETTGYPAEMLGLQMELESDLGIDSIKRVEILSAVRDRTPGLSEVDASALAQLRTLGQVVDHLRASLPAAGPAASASPAAVAPAAKASSV

SEQ ID NO: 40 - DNA, 7845 bp, Sorangium cellulosum
  source 1..7845: /mol_type="DNA" /organism="Sorangium cellulosum"
  CDS 1..7845: /codon_start=1 /product="pfa3"
gtgatcgaggccagcgtgttcgagcccatcgccatcgtcggccgcgggtgcgtcctcccgggcgcgctccaccccgcggccctctgggacaacgtgctcgccggcagggacctcctgtccgccgcccccgacggccgctggcgcctctcgcgcgagcgcgcgctcgcggggccttccgtgcgcggcgcgcgcgacgtgcgcgacgcgcaggaccgcgcgtggagcgaccgcggcggctacgtcgccgggttcgacgagcacttccgccgcgtgctcgccagggacccgttcccgcggcggggcgggccgcccgagtccctgctcgcgctcgacccgctcttccagtgggtgctccacgcgggccgcgaggcgctgcgcgaggcggggcacgagggccggtccgaccgcgcgggcgcggtgttcgggaacctctcgttcccgtcgtcggcgatgtcggcgtgggtcgagtcgacgtggctcggcgatctcgccggcgtcccgcggcccgatccgcgcaaccggttcatgtcggggctgcccgcccacctgctggccgacgtgctcggcctcggggccggcgcgttcgcgctcgacgccgcgtgcgcgtcgtcgctgtacgcgatcgcgctcgcctgcgagcggctgcacgatcgcgaggccgaccggatgctcgcaggcgcggtgtgccgctcggacgatctcttcatccacatcgggttctgcgcgctgtcggccatgagccgcaccgggcagagccgcccgttctcgtcggaggccgacggcctggtcccggcggagggcgcggcgttcgtggtcctggagcgcctgtcggacgcggaggccgcgggcaggccgatcctcggcgtgatccgcggggtcggcctgtcgaacgacggccgcggccgcggcctcctcgcgcccgccgtcgagggccagctgcgcgcgatgcgggccgcgtatgcgacggccggcctcgatcctcgcgaggtgtcgctgctcgagtgccacgcgacgggcacgcccctcggcgacgcgaccgagatcgcgaccctcaaggaggtgttcggctcccgcgaggtcccgctcggctcgctcaagtcgaacctcggtcacctcgtcacgacggccggcgcggccgggctcctcaagctgctcggcgccatggcggcgggcatccgcccgccgacgctgcacgccgatccgctgagcgaggcggtcgcctcgagccccttccgggtgctgcagcgcgccgagccgtgggaggggcgtcggctcgcgggcctgtcggcgttcgggttcggcgggaacaacgcccacctcctcgtggaggcgtacgagccgtcgtcgccgaggagccgagcggcccacgccgcgccgcaggtcgctgcagcggcctcgcgccctgtcgatgccgcgcgccccgcgccggcaggccacctggccgtggtggccatgggcctgtgcgtcggtgagctcagcggcgtccgggccttcgccgagccgctcctctcgggccgcagcgcagatcctcgccgcgcggccgtcgcgctgcccgcggaccggctccggttcccgccgcgcgatctgcagcaggcgctcgcccagcagacgctgctgctcgaggcggcgatcgaggccaccgaggggctcgcgctgccgcgcgatcgcaccgccgtgctcatcggcatgggcgccgacaccgaggtgtgcaggtacatgacgcgctggcggctcgccgagacggcgccggcgcggctcggtccgtcggccgacgtcggcgcgctccaggacgcgatcatccctgcgctgcaggcggcgggcgtcgtcgggaacatgccgaacatcccggcgaaccggctgaacagccagctcgacgtcggtggaccgtcgttcacgatcgccgccgaggagctgtcgggcccctgggcgctgcgcgtcgcgtcccgcgccctgcgcgccggcgcggtcgacgcggcgatcgtcggcgcggtggatctctcgtgcgagcccgcccacgcggccgcgctcgaggcgctcggcgtccacctgccccccggcgacgccgccgtggtgctcgtgctcgagcgcctcgacgacgccgtccgggagcggcacccggtcctggcggtggtcgtggacgagccgggcgaccctggcctcgtgctgtcgtccacggatctcgcgccgcggttcggccacgcgcacgccgcgtcggggctgctgcacgtggccgccgcggtgctcgcgtgccgtcacggccgcaggctcgacggggcgccgtggtccgacgagatccgggtcgccgaggtccgctgcgccggcctcggcggcggctcgctgtcggtccgcatcggggccggcggccctgccgcgccgctcccgccgccgcgatcggcggaggggccgatgctcacgctccccgcccacccgccggcgatcgtcgtgcccggcgcggcctcctgttcatcccccggagactccatggaacctgcgccgcctctgccgtccgctctcgacgacctgccgccgctgtaccccgggcccacggggttctctgccgccgacgcggagcgggcgccgtcctgggacgagccggcggcggtcgagccggcggtcgtcgcggccgtcgccgcgagcctggcagaggagccgccgccggtcggaccggcggtcgtcgcggccgctgccgtggatatcccgggcgacgtgatcgccggcgccgcggcgttcaccgtgcagcttgcgcagatccacaaggagtgggcggagcagcaggcccaggtccaccatcggttccttcagatgcggcagcgcgcgctgcactcgctcgtgcaggcgtcgtcgggcgcggccgcggtggtggtcgaggcccccttggcgcaggcgccccacgccgcgccggtccgtaccgaggccccgcgtccggtcgagtcgccgcctctcgcgcgcatcgaggcgctgcgccctgccgctgcgccgcagccgatcgaggcgccgcgtctcgtccgcgccgaaccgccgcagcctgcccgcgccgagccgccgcgctcgttcgagccgcgtgtcgtcgagccgcgcgtcgtcgagccgccgcgccccgccgccgcgccgcctgcgccgcgccccgccgcccagccggagctccccgcggcgtcttccctcgcgccccgcggcccccggttcagccgcgagcagctcgagcacctcgcctcgggccggatctccgacgtgttcggcccgctcttcgcccggcaggacgcctatcgacgccaggtacgcatgcccatgccgccgctcctgctggccgatcgggtcaccgggatcgacgccgagcccggctcgatgaagctcggcacgatgtggaccgagaccgacgtgcggtgggattcctggtacctgcacgacggcgcgatgccggccggcgtcatgatcgagagcggccaggccgacctgctgctcatcagctggctcggcgcggacttcgagaacaagggcgagcgcgtctaccgcctgctcggctgcgagctcaccttctacggcggcctgccgcgcccgggcgacacgctcgtctacgacatccacgtcgacgggcacgcgaagcacggcgacgtccgcctgttcttcttccactacgactgccgcatcggcggcgagctgcgcctgaagacgcgcaagggccaggcaggcttcttcaccgacgaggagctcgcgagctccggcggcgtcctctgggacgcggacaccgccgagcatgcgacgaccgcccgcctcgatccgccccggatcgcgtgccagaagtccgcgttcgaccgggccgacctcctcgcgttcgcggccggcgacggcgcggcggcgttcggccccgccttcgatcgtttgagcacccacgtcaggacgccgcggatcagcgcgccgccgatgctgttcttcgatcgcgtcgacgtgttcgacccggcgggcggcccgtggaagcgcggctatctccgggccacgctgccgatcacgaaggacggctggtatttcgagggccacttcaaggacgacccctgcatgccggggacgctcatgttcgagggctgcctgcaggcgctcgcgttctacatggcggccatgggcttcacggtggacgcggacggcttccgcttcgagcccgtgccggagatcccctacctgctccgctgccgcggccaggtggtcccgacgagccgcgtgctcacctacgaggtgttcatcgaggaggtccacgacggcccgtgcccgacggtgttcgccgacttcctgtgtacggtcgacggcctcaaggcgttccacgcccgccgcgtgggcctgcgcctcagccccgactggccgctgacgagcgcgcccgagctgctcgacggtcacgtcgagccggtgccggtcgcgcgtgtcccctggtccgagacgggcgcgcctccgccggacggcgccgctgcagacgcgggcggcttcccgttcgattaccggagcctgctctcgtgcgcctggggcaggccgtcggacgcgttcgggccgctctaccgcaggttcgacgcgggacagcacgtcgcccggctcccggggccgccgtaccatttcatgagccgggtcctgtcggtctcgcgccccatggcggcgatgaaggccggcgccgaggtcgaggtcgagtacgacgtcccggaggacgcgtggtacttcgacgagaacgcgagcctcacgatgccgttcgcggtggtgctcgaggccgcgctccagacgtgcggctggctcgcgagctacgccggctgcgcgctctcgaccgacggcgcgctgtacttccgcaacctcgacggcaagggcacgctgcacgccgaggtccttccggcgccggcgccggcagtgagcgcgctgcgcaccaggtcgcggctcacgaacatgtcccggtcgggcggcatgatcatcctctcgttccgggtcgagtgcagcctcggcggcgcgcgggtgtacgagctcgacacggtgttcggcttcttcccgaaggccgcgctcgcgacgcagatcgggatcccgccgaggcccgaggaggtcgccgcgctcgatgagccgtccgatttcgaggtcgatctccgcgagcgccccgcgcggtactgcggcggcaagctcgggctcgcgcggccgtcgctgctgatgatcgaccggatcgacggcctgtggcaggccggcggccggaaggggctcggccggctccgcgcgcggcgggacgtccacgcgtcggagtggttcttcaaggcccatttcctgggcgatcccgtgcagccaggctcgctcggcatcgaggcgatgctgcagacgatccagttctggatgctgcaccaggacctccacgcgggcctgcgcgatccgcggttcgagcccgtgatgacggggcacgagcactcctggcggtaccggggccaggtgctgccggccagccgacgggtgacggtcgacaccgacatcctcgaggtcggccgcgacgaccgcgggccctacgtcatcgccgagtcctacctctgggtggacggcctgcgcatctacggcgcgacgctcggcgtgaggatcgtcgacggcgcctcgtcccgagcgcggcgcgacgtcggcttcgacccgcgcgcgagcgcgcgccgcctcgcgtcgctccccggcgccgtaggcgggagcccgcgcctgcgcccgcaggagccgcccgcggcgaaggccgcgccggcggcgctcgacgacgctgaagaggtgctggacccggacgggtgggtggcggaccatcgccccacgtggacgctcccggcgctccccgggatgagcatggtcgaccggctggccggcgcagcgttgcgggcgcgcccggggagcgtggtcgtggccgtggaggacgtggtggtgcagcgctggctgcccgtgccggggccggtgcgcgtcaaggccgaggcgaccggctcgggcgacgtcctcgatgtccggctgctcgcgtggcgcgaggcatcgaacccggcgctctcgcggttcgagcccgtgtgcaccggccgcgttcgggtggcccgtgactacccgcccgccccggcgccggagccggcgctcgacgcgcctgaggcggacgatccgtacgcggcggggacgctgttccacggccctgcgttccagtacctgacctcgctcaggctcggcgcgcgcggctcgtcggcggtgctggacccccggaggggctcggtgcccccagggacgctgcaccagggcatgctcgacgcgctgacccacaccatcccgcacgatcggctgtcgctgtgggatccagggtgcccgcccgcccagatcgcgttcccgtcgcgcatcccgtcgctccgcgtgtacgggccggcgcccgggtcgccggtgcgcgtggaggtgcgttacgagggccgtgacgatcgcttcgtctcgttccgggtgcaggccatcgcgcaggccggggccgaggtcggggccgcggcgggagagcgcgtctggctggagctccggcttgtcgaggtgctgctcccgcaggggccgatcggcggcgcgccgcccgggatccgccgggcgttcctgcgcgatcgcgcgccggtcgacctcgccgtctcgcgcgtcgacgcggcgtcgggcgaggcgcgctgcagccccgccgacgtgcgcacgatggactggatgcccggcaccgtggcgcagctctacgccgcgtcgggcgacctcgtcgaggcggcggccgtgaaggatcacgtcgcgcggcgcgcgggcgtgcacccgtcgaccgtgtccctcgccggcgtctcgtcggcgcagccgctgacgcgctggccgttcaccgtggcgcgcgagggctccgaggtcgtggtccgcgacgcgggcccgcccgtgatcgacatcgcgccggtccgccgctactggggcgcggccatgggcatcggccggtggccggcggaggacctctacttcgggctcatcgagcggttcatccgccgggtgcacgtcgtcgatcccgcggcgttccgcgccgtgaagggccggagcctgctctacctcggcaaccaccaggtcggcgtggagtcgctgctgttcggcatcgccgtgtccggcctgacggaggtctcgacggtcacgctggccaaggccgagcaccggacgacgtggctcggcacgatgctggcgcactgcttcgcgtatcctggcgcgcgcgatccgaaggtgatcacgtacttcgatcgcgaggacaaggcgtcgctcgggaccatcatcgccgagctcggggccgagatgcagggggccggcaagggcgtgatggtgcacgtcgagggcacgcgatcgctcgagtgccgcacgccggtgcgcaagatgagcggctcgttcatcgacatggcgctcgcggtgggcgtcccggtggtgcctgtgcgcttctccggcgcgctgccgccggagccgctcgagcggcggctcgagttcccgctcggcatgggcgtgcaggacatctggatcggccgcccgctgctgcccgaggagctcgcggggctgacctacaaggaccgcaaggacctcgtgatcagcggcatcaacgggctcggcccgagcaacgcggtcgagcagccgttccccggggatcctgcgttcgcggcgtcggtggacgcctgggtggaggaggcgggcgtcgcgcacgaggacgcgacggtcttccgggtgctgcaggcgtgcgccgacccgacgccggagacggccgcgatcctggaggccgcgcgcacggggcggctcgtcgcgcccgacgcgcggcgggcggactggctgcggaagctcgcggcgcggctcctcgggaggcggctcggggggtga

SEQ ID NO: 41 - protein, 2614 aa, Sorangium cellulosum; identical to SEQ ID NO: 35
  SOURCE 1..2614: /mol_type="protein" /note="This sequence is generated from feature [CDS]: 1..7845 placed under sequence number 40" /organism="Sorangium cellulosum"

SEQ ID NO: 42 - DNA, 1650 bp, Sorangium cellulosum; identical to SEQ ID NO: 36
  source 1..1650: /mol_type="DNA" /organism="Sorangium cellulosum"
  CDS 1..1650: /codon_start=1 /product="domain I" /transl_table=1

SEQ ID NO: 43 - protein, 549 aa, Sorangium cellulosum; identical to SEQ ID NO: 33
  SOURCE 1..549: /mol_type="protein" /note="This sequence is generated from feature [CDS]: 1..1650 placed under sequence number 42" /organism="Sorangium cellulosum"

SEQ ID NO: 44 - protein, 549 aa, Sorangium cellulosum; identical to SEQ ID NO: 33
  SOURCE 1..549: /mol_type="protein" /organism="Sorangium cellulosum"

SEQ ID NO: 45 - DNA, 3531 bp, Sorangium cellulosum
  source 1..3531: /mol_type="DNA" /organism="Sorangium cellulosum"
  CDS 1..3531: /codon_start=1 /gene="domain IIa" /transl_table=11
atgcacccttcgtcttcgcgtatcccgtccatcgccgtcgtcggcgtgagcgccatcttccccggctcgctcgacgcgcacggcttctggcgtgacatcctgtccgggacagacctcatcacggatgtcccgagcacccactggctggtcgaggactactatgatcccgacccgtccgccccggacaagacgtatgcgaagcgcggcgcctttctcaaggacgtgccgttcgatccgctcgagtggggcgtcccgccctcgatcgtgccggcgacggacacgacgcagctgctcgcgctgatcgtggcgaagcgggtcctcgaggacgcggcgcaggggcagttcgaggcgatgaaccgcgagcggatgagcgtgatcctcggcgtcacctccgcgcaggagctgctcgcgtcgatggtgagccggatccagcggccggtgtgggcgaaggcgctccgggacctcgggtatccggaggacgaggtgaagcgcgcctgcgacaagatcgcaggcaactacgtgccgtggcaggagtcgagctttccgggcctgctcgggaacgtggtggccgggcgcatcgcgaaccggctcgacctcggcgggacgaactgcgtgaccgacgcggcgtgcgcgtcgtcgctgtcggcgatgtcgatggcgatcaacgagctggcgctcgggcagtccgatctcgtgatcgcgggcggctgcgacacgatgaacgacgcgttcatgtacatgtgcttcagcaagacgcccgcgctgtccaagtcgggcgactgcaggccgttctccgacaaggccgacgggacgctgctcggcgaggggatcgggatggtggcgctcaagcggctcgacgacgccgagcgcgacggggaccgggtctacgcggtgatccgcgggatcggctcgtcctcggacgggcggagcaagagcgtgtacgcgccggtgccggaagggcaggcgaaggcgatccgccggacgtacgccgcggccgggtacggccccgagaccgtggagctgatggaggcgcacggcaccgggacgaaggccggcgacgcggccgagttcgagggcctgcgcgcgatgttcgacgcgtcggggcgcgctgaccgccagtggtgcgcgctcggcagcgtgaagtcgcagatcggccacaccaaggcggcggccggcgcggccggcctgttcaaggcgatcatggcgctgcaccacaaggtgctcccgccgaccatcaaggtcgacaagccgaaccccaagctggagatagaaaagaccgctttctatctcaacacccaggcgcggccgtggatccggccgggggaccacccgcggcgggcgtcggtgagctcgttcggcttcggcggctcgaacttccacgtggcgctggaggagtacacgggcccggcgccgaaggcgtggcgggtgcgggccctgccggcggagctgttcctcctgtcggcggacacgccggcggcgctcgcggatcgcgcgcgggcgctggcgaaggaggcggaggtgccggagatcctgcgcttcctggcgcgggagtcggtgctctcgttcgacgcgtccaggccggcgcggctcgggctgtgcgcgacggacgaggcggatctcaggaagaagctcgagcaggtcgcggcgcacctcgcggcgaggccggagcaggcgctctcggcgccgctcgtgcactgcgcgagcggggaggcgccggggcgggtggcgttcctgttcccggggcaggggagccagtacgtcgggatgggcgcggacgcgctcatgacgttcgacccggcccgcgcggcctgggacgcggcggcgggcgtcgcgatcgcggacgcgccgctgcacgaggtggtgttcccgcggccggtgttctcggacgaggaccgggcggcgcaggaggcgcggctccgcgagacgcggtgggcgcagccggcgatcggcgcgacgagcctctcgcacctcgcgctgctcgcggcgctcggggtgcgggccgaggcgttcgcgggccacagcttcggcgagatcacggcgctgcacgcggccggggcgctgtccgcggcggacctcctgcgcgtggcgcggcggcgcggcgagctgatgggcgcggcgtcgtcggagcggggcgcgatgatcgcggtcccgcgggggatcgacgaggtgcgggcgctcggcctcggcggcgtggtgatcgcgaaccacaacggcccgaagcaggtggtgctgtcgggctcggtcgcggcgatcgaggccgcggaggagcggctgaagggcgtcgggatccaggcgcggcgcctcgacgtggccgcggcgttccactcgccgctcgtggcggaggcgagcgcgccgctccgcgagttcctggcgggcatcgcggtcgaggcgccggcggcgcccgtgtacagcaacgcggagatcgagccgtacgcgggcggcggcgacgcggcgcgcgaccggctggcgcggcagctcgcggagcctgtgcggttcgtcgaggagatcgagcggatgtacgcggacggcgtgcgcacgttcgtcgaggtcgggccgggctcggtgttgtcgaacctggtcggcgacatcctgagcggtcggccgcaccgggcggtggcgctcgaccgcaagggcaagcacggcgtgacgagcctgctcgaggcggtggcgcggctcgccgtggccggggtgccgctggacacgcgggtcctctgggaaggcttcgcggcgccgagcgatccgcgggcgctgccgaagccgaagctggcgctgcagatcaacgggagcaactacggcaagccgtacccgccgcaggggggcgcgaaggcgctgccggcggcgagcccgccgcgggcggcgcagaagccggcgccggaggcggcgcgggcggtggcgagcgcgccgcggccggtggcgagcgcgtcgcaggcggcagtgagcacgtcgcggccggtggtgagcgcgtcgcagccggcagtgagcgcgtcgcaggcggcagtgagcgcgtccgcgccggtggtgagcgcgtcgcaggcggcagtgagcgcgtcgcggctggcagtgagcgcgtcgcagccggcagtgagcgcgtcgcagccggtggtgagcgcgtccgcgcctgcgctggcgagcgcgtccgcgcctgtggtgagcgcgccgcggccggcagtgagctcgtcgacgcccgtggtgagcgcgtcgcggccgacggcgagcgcgtcgtggctggccgcgtaccaggaggcgcagcgcgcgacggcggaagcccacagcgtgtaccagcggacgatggccgagagccacatcgccttccttcaggccgccgaggcgtccttcgcagggcttgccgcgctggcgaccggcgctccgtaccccgtcgctccaacgacggtgtccgaggtacggcctgctccggttctcctcgctccggtgcatgtggggcctgtctcggaggcgtccctacggctttcggcggcgccgaccgcgcgctccggcgagggcaggagcaacgtggccctggacggcccgaac

SEQ ID NO: 46 - protein, 1177 aa, Sorangium cellulosum
  SOURCE 1..1177: /mol_type="protein" /note="This sequence is generated from feature [CDS]: 1..3531 placed under sequence number 45" /organism="Sorangium cellulosum"
MHPSSSRIPSIAVVGVSAIFPGSLDAHGFWRDILSGTDLITDVPSTHWLVEDYYDPDPSAPDKTYAKRGAFLKDVPFDPLEWGVPPSIVPATDTTQLLALIVAKRVLEDAAQGQFEAMNRERMSVILGVTSAQELLASMVSRIQRPVWAKALRDLGYPEDEVKRACDKIAGNYVPWQESSFPGLLGNVVAGRIANRLDLGGTNCVTDAACASSLSAMSMAINELALGQSDLVIAGGCDTMNDAFMYMCFSKTPALSKSGDCRPFSDKADGTLLGEGIGMVALKRLDDAERDGDRVYAVIRGIGSSSDGRSKSVYAPVPEGQAKAIRRTYAAAGYGPETVELMEAHGTGTKAGDAAEFEGLRAMFDASGRADRQWCALGSVKSQIGHTKAAAGAAGLFKAIMALHHKVLPPTIKVDKPNPKLEIEKTAFYLNTQARPWIRPGDHPRRASVSSFGFGGSNFHVALEEYTGPAPKAWRVRALPAELFLLSADTPAALADRARALAKEAEVPEILRFLARESVLSFDASRPARLGLCATDEADLRKKLEQVAAHLAARPEQALSAPLVHCASGEAPGRVAFLFPGQGSQYVGMGADALMTFDPARAAWDAAAGVAIADAPLHEVVFPRPVFSDEDRAAQEARLRETRWAQPAIGATSLSHLALLAALGVRAEAFAGHSFGEITALHAAGALSAADLLRVARRRGELMGAASSERGAMIAVPRGIDEVRALGLGGVVIANHNGPKQVVLSGSVAAIEAAEERLKGVGIQARRLDVAAAFHSPLVAEASAPLREFLAGIAVEAPAAPVYSNAEIEPYAGGGDAARDRLARQLAEPVRFVEEIERMYADGVRTFVEVGPGSVLSNLVGDILSGRPHRAVALDRKGKHGVTSLLEAVARLAVAGVPLDTRVLWEGFAAPSDPRALPKPKLALQINGSNYGKPYPPQGGAKALPAASPPRAAQKPAPEAARAVASAPRPVASASQAAVSTSRPVVSASQPAVSASQAAVSASAPVVSASQAAVSASRLAVSASQPAVSASQPVVSASAPALASASAPVVSAPRPAVSSSTPVVSASRPTASASWLAAYQEAQRATAEAHSVYQRTMAESHIAFLQAAEASFAGLAALATGAPYPVAPTTVSEVRPAPVLLAPVHVGPVSEASLRLSAAPTARSGEGRSNVALDGPN

SEQ ID NO: 47 - protein, 1177 aa, Sorangium cellulosum; identical to SEQ ID NO: 46
  SOURCE 1..1177: /mol_type="protein" /organism="Sorangium cellulosum"

SEQ ID NO: 48 - DNA, 1776 bp, Sorangium cellulosum
  source 1..1776: /mol_type="DNA" /organism="Sorangium cellulosum"
  CDS 1..1776: /codon_start=1 /gene="domain IIb" /transl_table=11
ggcgcgggcggggagctccacacggctgtcgcgctgccggcgcaggcggcgcctgccgtggcagcgaaggtggccgttgcagcgcccgccgcgacagcaaaagcggccaccgcggcgccagctgcgcctgtgaaggcggcagccgctgcgcccgcggtggcagtgtccacggccgtcaccgcgcctgccgccgtggcgacgcaggcggcggtcgccgctgcgccgcgcgtcgatatcgagcgcttggtgctcgacgtggtcgcggacaagacggggtaccccgtctccatgctggggctgcagatggagctggagagcgatctcggcatcgacagcatcaagcgggtggagatcctgtcctcggtccgtgaccggacgccggggctgtcggaggtcgacgcctcggccctggcgcagctgcgcacgctggggcaggtcgtcgaccacctccgcgcctcgctgccggccgccgggccggccgccagcgccagtcccgctgtcgccgcgcccgccgcgaaggcatctgccgtcgcggcgcccgcggccgcttccgtcggggcgcctggcgcggccgaggtggagcgtgtggtgatggcggtcgtcgcggagacgacgggctatccggcggagatgctcgggctgcagatggagctggagagcgacctcggcatcgacagcatcaagcgggtggagatcctgtcggcggtccgtgaccggacgcccgggctgtcggaggtcgacgcgtcggcgctggcgcagctgcgcacgctggggcaggtcgtcgatcacctccgcgcctcgctgccggccgccgggccggcagcgagcgccagtccggctgccgtcgcgcccgccgcgaaggcgtcttccgtcacggtgcctaccgtcgcttccagcgccgcgccaggcgcggccgaggtggagcgagtcgtgatggcggtcgtcgcggagacgacgggctacccggcggagatgctcgggctgcagatggagctggagagcgacctcggcatcgacagcatcaagcgggtggagatcctgtcggcggtccgcgaccggacgccggggctgtcggaggtcgacgcgtcggcgctggcgcagctgcgcacgctggggcaggtcgtcgatcacctccgcgcctcgctgccggccgccagcgccagtccggctgtcgccgcgtccgccgcgaaggcgcctgccgtcgcggcgcctggcgccgcttccggcgcggcgcctggcgcggccgaggtggagcgagtcgtgatggcggtcgtcgcggagacgacgggctacccggcagagatgctggggctgcagatggagctggagagcgacctcggcatcgacagcatcaagcgggtggagatcctgtcggcggtccgcgaccggacgcccgggctcgcggaggtcgacgcctcggcgctggcgcagctgcgcacgctggggcaggtcgtcgaccacctccgcgcctcgctgcctgccgccagcgccagcccggcagtcgtcgcgcccgccgccacggtgcctgccatcgcagcgcccgccgttgctttcgcatcggcgcccgcggcggccgaggtggagcgagtggtgatggcggtcgtcgcggagacgacgggctacccggcggagatgctcgggctgcagatggagctggagagcgatctcggcatcgacagcatcaagcgggtggagatcctgtcggcggtccgcgaccggacgcccgggctcgcggaggtcgacgcctcggcgctggcgcagctgcgcacgctgggg

SEQ ID NO: 49 - protein, 592 aa, Sorangium cellulosum
  SOURCE 1..592: /mol_type="protein" /note="This sequence is generated from feature [CDS]: 1..1776 placed under sequence number 48" /organism="Sorangium cellulosum"
GAGGELHTAVALPAQAAPAVAAKVAVAAPAATAKAATAAPAAPVKAAAAAPAVAVSTAVTAPAAVATQAAVAAAPRVDIERLVLDVVADKTGYPVSMLGLQMELESDLGIDSIKRVEILSSVRDRTPGLSEVDASALAQLRTLGQVVDHLRASLPAAGPAASASPAVAAPAAKASAVAAPAAASVGAPGAAEVERVVMAVVAETTGYPAEMLGLQMELESDLGIDSIKRVEILSAVRDRTPGLSEVDASALAQLRTLGQVVDHLRASLPAAGPAASASPAAVAPAAKASSVTVPTVASSAAPGAAEVERVVMAVVAETTGYPAEMLGLQMELESDLGIDSIKRVEILSAVRDRTPGLSEVDASALAQLRTLGQVVDHLRASLPAASASPAVAASAAKAPAVAAPGAASGAAPGAAEVERVVMAVVAETTGYPAEMLGLQMELESDLGIDSIKRVEILSAVRDRTPGLAEVDASALAQLRTLGQVVDHLRASLPAASASPAVVAPAATVPAIAAPAVAFASAPAAAEVERVVMAVVAETTGYPAEMLGLQMELESDLGIDSIKRVEILSAVRDRTPGLAEVDASALAQLRTLG

SEQ ID NO: 50 - protein, 592 aa, Sorangium cellulosum; identical to SEQ ID NO: 49
  SOURCE 1..592: /mol_type="protein" /organism="Sorangium cellulosum"

SEQ ID NO: 51 - DNA, 2397 bp, Sorangium cellulosum
  source 1..2397: /mol_type="DNA" /organism="Sorangium cellulosum"
  CDS 1..2397: /codon_start=1 /gene="domain IIc" /transl_table=11
caggtcgtcgaccacctccgcgcgagcctcggttccgccgctgtcaccgccggcgctgcgccggcggagcccgccgaggagccggcctccgcgcccctcggccggtggacgctcgtcgaggagccggcgcccgcggccggcctcgcgatgcccggcctcttcgacgcaggcaccatcgtggtcaccggccacgacgcgatcggccccgcgctcgtcgcggccctcgcggcgcgcgggatcgccgccgagtacgcccccgccgtgccccgcggcgcgcgcggcgccgtgttcctcggcggcctgcgcgagctggccacggccgacgaggcgctcgccgtccaccgcgaggcgttcctcgctgcccaggcgatcgcggcgaagccggccctgttcgtcacggtccaggacaccggcggcgacttcggcctcgcgggctcggaccgcgcctgggtcggcgggctgccgggcctcgtgaagaccgcggcgctggagtgggccgaggcgtcctgccgcgcgatcgacctcgagcgcggcggccgccccgccgccgagctcgcggaggccatcgcctcggagctcctgtccggcggcgtcgagctcgagatcggcctgcgcgcggacggccggcgcaccgcgccgcgaagcgtccggcaggacgcgcagcccgggccgctccccctcgggccgtccgacgtggtcgtggcgagcggcggcgcccgcggcgtcaccgcggcgacgctgatcgcgctcgccagggccagccgcgcgcggttcgcgctgctcggccgcaccgcgctcgaggacgagccggccgcctgccgcggcgccgacggcgaggccgcgctcaaggcggcgctcgtcaaggcggcgacctccgcgggccagcgggtgaccccggcggagatcggcaggagcgtggcgaagatcctcgcgaaccgcgaggtccgcgcgacgctcgacgcgatccgcgccgccggcggcgaggccctctacgtcccggccgacgtgaacgacgcgcgggcggtggccgcggcgctcgacggcgtgcgccgcgccctcggccccgtcacggcgatcgtccacggcgcgggcgtgctcgccgacaagctcgtcgccgagaagacggtcgagcagttcgagcgcgtgttcagcacgaaggtcgacggcctccgggccctgctcggcgcgaccgcgagcgacccgctcaaggcgatcgtcctcttcagctcgatcgccgcgcgcggcggcaacaaggggcagtgcgactacgcgatggcgaacgaggtcctgaacaaggtcgcggccgccgaggcagcccgccgccccggctgccgggtgaagtcgctcggctggggcccctggcaaggcggcatggtgaacgcggcgctcgaggcccacttcgcgcagctcggcgtgccgctcatcccgctcgccgcgggcgcgaagatgctcctcgacgagctgtgcgacgcctcaggcgatcgcggcgatcgcggcgcgcgcgggcaaggcggcgccccgcccggcgcggtcgagctcgtgctcggcgcggagccgaaggcgctcgcggcccagggccagggcggccgggtcgcgctggccgtccgcgcggaccgcgcgacgcacccctacctcggcgatcacgccatcaacggcgtccccgtggtgccggtggtgatcgcgctcgagtggttcgcccgcgccgcgcgcgcgtgccggccggatctcgtcgtcaccgagctccgcgacgtgcgggtcctgcgcgggatcaagctcgccgcgtacgagtccggcggcgaggtgttccgcgtcgactgccgcgaggtgagcaacggccacggcgcggtgctcgcggcggagctgcgcgggccgcagggggcgctgcactacgcggcgaccatccagatgcagccgcccgaagggcgcgtggccccgaagggcccggccgcgccggagctcggcccgtggccctccggcggcgagctgtacgacggccgcacgctcttccacggccgcgacttccaggtgatccggcggctcgacggcgtgagccgcgacgggatcgcggggacggtcgtgggcctccgcgaggccggctgggtggcccagccgtggaagaccgatccggcggcgctcgacggcgggctgcagctcgcgacgctgtggacgcagcacgtgctcggcggcgcggcgctcccgatgtccgtgggcgcgctgcacaccttcgccgaggggccgtccgacggcccgctgcgcgcggtggtgcgcgggcagatcgtggcccgcgatcgcacgaaggccgacatcgcgttcgtcgacgaccgcggctcgctcgtcgcggagctgcgcgacgtgcagtacgtcctgcgccccgacacggcgcgcgggcaggcgtga

SEQ ID NO: 52 - protein, 798 aa, Sorangium cellulosum
  SOURCE 1..798: /mol_type="protein" /note="This sequence is generated from feature [CDS]: 1..2397 placed under sequence number 51" /organism="Sorangium cellulosum"
QVVDHLRASLGSAAVTAGAAPAEPAEEPASAPLGRWTLVEEPAPAAGLAMPGLFDAGTIVVTGHDAIGPALVAALAARGIAAEYAPAVPRGARGAVFLGGLRELATADEALAVHREAFLAAQAIAAKPALFVTVQDTGGDFGLAGSDRAWVGGLPGLVKTAALEWAEASCRAIDLERGGRPAAELAEAIASELLSGGVELEIGLRADGRRTAPRSVRQDAQPGPLPLGPSDVVVASGGARGVTAATLIALARASRARFALLGRTALEDEPAACRGADGEAALKAALVKAATSAGQRVTPAEIGRSVAKILANREVRATLDAIRAAGGEALYVPADVNDARAVAAALDGVRRALGPVTAIVHGAGVLADKLVAEKTVEQFERVFSTKVDGLRALLGATASDPLKAIVLFSSIAARGGNKGQCDYAMANEVLNKVAAAEAARRPGCRVKSLGWGPWQGGMVNAALEAHFAQLGVPLIPLAAGAKMLLDELCDASGDRGDRGARGQGGAPPGAVELVLGAEPKALAAQGQGGRVALAVRADRATHPYLGDHAINGVPVVPVVIALEWFARAARACRPDLVVTELRDVRVLRGIKLAAYESGGEVFRVDCREVSNGHGAVLAAELRGPQGALHYAATIQMQPPEGRVAPKGPAAPELGPWPSGGELYDGRTLFHGRDFQVIRRLDGVSRDGIAGTVVGLREAGWVAQPWKTDPAALDGGLQLATLWTQHVLGGAALPMSVGALHTFAEGPSDGPLRAVVRGQIVARDRTKADIAFVDDRGSLVAELRDVQYVLRPDTARGQA

SEQ ID NO: 53 - protein, 798 aa, Sorangium cellulosum; identical to SEQ ID NO: 52
  SOURCE 1..798: /mol_type="protein" /organism="Sorangium cellulosum"

SEQ ID NO: 54 - DNA, 2994 bp, Sorangium cellulosum
  source 1..2994: /mol_type="DNA" /organism="Sorangium cellulosum"
  CDS 1..2994: /codon_start=1 /gene="domain IIIa" /transl_table=11 /translation="VIEASVFEPIAIVGRGCVLPGALHPAALWDNVLAGRDLLSAAPDGRWRLSR
gtgatcgaggccagcgtgttcgagcccatcgccatcgtcggccgcgggtgcgtcctcccgggcgcgctccaccccgcggccctctgggacaacgtgctcgccggcagggacctcctgtccgccgcccccgacggccgctggcgcctctcgcgcgagcgcgcgctcgcggggccttccgtgcgcggcgcgcgcgacgtgcgcgacgcgcaggaccgcgcgtggagcgaccgcggcggctacgtcgccgggttcgacgagcacttccgccgcgtgctcgccagggacccgttcccgcggcggggcgggccgcccgagtccctgctcgcgctcgacccgctcttccagtgggtgctccacgcgggccgcgaggcgctgcgcgaggcggggcacgagggccggtccgaccgcgcgggcgcggtgttcgggaacctctcgttcccgtcgtcggcgatgtcggcgtgggtcgagtcgacgtggctcggcgatctcgccggcgtcccgcggcccgatccgcgcaaccggttcatgtcggggctgcccgcccacctgctggccgacgtgctcggcctcggggccggcgcgttcgcgctcgacgccgcgtgcgcgtcgtcgctgtacgcgatcgcgctcgcctgcgagcggctgcacgatcgcgaggccgaccggatgctcgcaggcgcggtgtgccgctcggacgatctcttcatccacatcgggttctgcgcgctgtcggccatgagccgcaccgggcagagccgcccgttctcgtcggaggccgacggcctggtcccggcggagggcgcggcgttcgtggtcctggagcgcctgtcggacgcggaggccgcgggcaggccgatcctcggcgtgatccgcggggtcggcctgtcgaacgacggccgcggccgcggcctcctcgcgcccgccgtcgagggccagctgcgcgcgatgcgggccgcgtatgcgacggccggcctcgatcctcgcgaggtgtcgctgctcgagtgccacgcgacgggcacgcccctcggcgacgcgaccgagatcgcgaccctcaaggaggtgttcggctcccgcgaggtcccgctcggctcgctcaagtcgaacctcggtcacctcgtcacgacggccggcgcggccgggctcctcaagctgctcggcgccatggcggcgggcatccgcccgccgacgctgcacgccgatccgctgagcgaggcggtcgcctcgagccccttccgggtgctgcagcgcgccgagccgtgggaggggcgtcggctcgcgggcctgtcggcgttcgggttcggcgggaacaacgcccacctcctcgtggaggcgtacgagccgtcgtcgccgaggagccgagcggcccacgccgcgccgcaggtcgctgcagcggcctcgcgccctgtcgatgccgcgcgccccgcgccggcaggccacctggccgtggtggccatgggcctgtgcgtcggtgagctcagcggcgtccgggccttcgccgagccgctcctctcgggccgcagcgcagatcctcgccgcgcggccgtcgcgctgcccgcggaccggctccggttcccgccgcgcgatctgcagcaggcgctcgcccagcagacgctgctgctcgaggcggcgatcgaggccaccgaggggctcgcgctgccgcgcgatcgcaccgccgtgctcatcggcatgggcgccgacaccgaggtgtgcaggtacatgacgcgctggcggctcgccgagacggcgccggcgcggctcggtccgtcggccgacgtcggcgcgctccaggacgcgatcatccctgcgctgcaggcggcgggcgtcgtcgggaacatgccgaacatcccggcgaaccggctgaacagccagctcgacgtcggtggaccgtcgttcacgatcgccgccgaggagctgtcgggcccctgggcgctgcgcgtcgcgtcccgcgccctgcgcgccggcgcggtcgacgcggcgatcgtcggcgcggtggatctctcgtgcgagcccgcccacgcggccgcgctcgaggcgctcggcgtccacctgccccccggcgacgccgccgtggtgctcgtgctcgagcgcctcgacgacgccgtccgggagcggcacccggtcctggcggtggtcgtggacgagccgggcgaccctggcctcgtgctgtcgtccacggatctcgcgccgcggttcggccacgcgcacgccgcgtcggggctgctgcacgtggccgccgcggtgctcgcgtgccgtcacggccgcaggctcgacggggcgccgtggtccgacgagatccgggtcgccgaggtccgctgcgccggcctcggcggcggctcgctgtcggtccgcatcggggccggcggccctgccgcgccgctcccgccgccgcgatcggcggaggggccgatgctcacgctccccgcccacccgccggcgatcgtcgtgcccggcgcggcctcctgttcatcccccggagactccatggaacctgcgccgcctctgccgtccgctctcgacgacctgccgccgctgtaccccgggcccacggggttctctgccgccgacgcggagcgggcgccgtcctgggacgagccggcggcggtcgagccggcggtcgtcgcggccgtcgccgcgagcctggcagaggagccgccgccggtcggaccggcggtcgtcgcggccgctgccgtggatatcccgggcgacgtgatcgccggcgccgcggcgttcaccgtgcagcttgcgcagatccacaaggagtgggcggagcagcaggcccaggtccaccatcggttccttcagatgcggcagcgcgcgctgcactcgctcgtgcaggcgtcgtcgggcgcggccgcggtggtggtcgaggcccccttggcgcaggcgccccacgccgcgccggtccgtaccgaggccccgcgtccggtcgagtcgccgcctctcgcgcgcatcgaggcgctgcgccctgccgctgcgccgcagccgatcgaggcg

SEQ ID NO: 55 - protein, 998 aa, Sorangium cellulosum
  SOURCE 1..998: /mol_type="protein" /note="This sequence is generated from feature [CDS]: 1..2994 placed under sequence number 54" /organism="Sorangium cellulosum"
VIEASVFEPIAIVGRGCVLPGALHPAALWDNVLAGRDLLSAAPDGRWRLSRERALAGPSVRGARDVRDAQDRAWSDRGGYVAGFDEHFRRVLARDPFPRRGGPPESLLALDPLFQWVLHAGREALREAGHEGRSDRAGAVFGNLSFPSSAMSAWVESTWLGDLAGVPRPDPRNRFMSGLPAHLLADVLGLGAGAFALDAACASSLYAIALACERLHDREADRMLAGAVCRSDDLFIHIGFCALSAMSRTGQSRPFSSEADGLVPAEGAAFVVLERLSDAEAAGRPILGVIRGVGLSNDGRGRGLLAPAVEGQLRAMRAAYATAGLDPREVSLLECHATGTPLGDATEIATLKEVFGSREVPLGSLKSNLGHLVTTAGAAGLLKLLGAMAAGIRPPTLHADPLSEAVASSPFRVLQRAEPWEGRRLAGLSAFGFGGNNAHLLVEAYEPSSPRSRAAHAAPQVAAAASRPVDAARPAPAGHLAVVAMGLCVGELSGVRAFAEPLLSGRSADPRRAAVALPADRLRFPPRDLQQALAQQTLLLEAAIEATEGLALPRDRTAVLIGMGADTEVCRYMTRWRLAETAPARLGPSADVGALQDAIIPALQAAGVVGNMPNIPANRLNSQLDVGGPSFTIAAEELSGPWALRVASRALRAGAVDAAIVGAVDLSCEPAHAAALEALGVHLPPGDAAVVLVLERLDDAVRERHPVLAVVVDEPGDPGLVLSSTDLAPRFGHAHAASGLLHVAAAVLACRHGRRLDGAPWSDEIRVAEVRCAGLGGGSLSVRIGAGGPAAPLPPPRSAEGPMLTLPAHPPAIVVPGAASCSSPGDSMEPAPPLPSALDDLPPLYPGPTGFSAADAERAPSWDEPAAVEPAVVAAVAASLAEEPPPVGPAVVAAAAVDIPGDVIAGAAAFTVQLAQIHKEWAEQQAQVHHRFLQMRQRALHSLVQASSGAAAVVVEAPLAQAPHAAPVRTEAPRPVESPPLARIEALRPAAAPQPIEA

SEQ ID NO: 56 - protein, 998 aa, Sorangium cellulosum; identical to SEQ ID NO: 55
  SOURCE 1..998: /mol_type="protein" /organism="Sorangium cellulosum"

SEQ ID NO: 57 - DNA, 2745 bp, Sorangium cellulosum
  source 1..2745: /mol_type="DNA" /organism="Sorangium cellulosum"
  CDS 1..2745: /codon_start=1 /gene="domain IIIb" /transl_table=11
ccgcgtctcgtccgcgccgaaccgccgcagcctgcccgcgccgagccgccgcgctcgttcgagccgcgtgtcgtcgagccgcgcgtcgtcgagccgccgcgccccgccgccgcgccgcctgcgccgcgccccgccgcccagccggagctccccgcggcgtcttccctcgcgccccgcggcccccggttcagccgcgagcagctcgagcacctcgcctcgggccggatctccgacgtgttcggcccgctcttcgcccggcaggacgcctatcgacgccaggtacgcatgcccatgccgccgctcctgctggccgatcgggtcaccgggatcgacgccgagcccggctcgatgaagctcggcacgatgtggaccgagaccgacgtgcggtgggattcctggtacctgcacgacggcgcgatgccggccggcgtcatgatcgagagcggccaggccgacctgctgctcatcagctggctcggcgcggacttcgagaacaagggcgagcgcgtctaccgcctgctcggctgcgagctcaccttctacggcggcctgccgcgcccgggcgacacgctcgtctacgacatccacgtcgacgggcacgcgaagcacggcgacgtccgcctgttcttcttccactacgactgccgcatcggcggcgagctgcgcctgaagacgcgcaagggccaggcaggcttcttcaccgacgaggagctcgcgagctccggcggcgtcctctgggacgcggacaccgccgagcatgcgacgaccgcccgcctcgatccgccccggatcgcgtgccagaagtccgcgttcgaccgggccgacctcctcgcgttcgcggccggcgacggcgcggcggcgttcggccccgccttcgatcgtttgagcacccacgtcaggacgccgcggatcagcgcgccgccgatgctgttcttcgatcgcgtcgacgtgttcgacccggcgggcggcccgtggaagcgcggctatctccgggccacgctgccgatcacgaaggacggctggtatttcgagggccacttcaaggacgacccctgcatgccggggacgctcatgttcgagggctgcctgcaggcgctcgcgttctacatggcggccatgggcttcacggtggacgcggacggcttccgcttcgagcccgtgccggagatcccctacctgctccgctgccgcggccaggtggtcccgacgagccgcgtgctcacctacgaggtgttcatcgaggaggtccacgacggcccgtgcccgacggtgttcgccgacttcctgtgtacggtcgacggcctcaaggcgttccacgcccgccgcgtgggcctgcgcctcagccccgactggccgctgacgagcgcgcccgagctgctcgacggtcacgtcgagccggtgccggtcgcgcgtgtcccctggtccgagacgggcgcgcctccgccggacggcgccgctgcagacgcgggcggcttcccgttcgattaccggagcctgctctcgtgcgcctggggcaggccgtcggacgcgttcgggccgctctaccgcaggttcgacgcgggacagcacgtcgcccggctcccggggccgccgtaccatttcatgagccgggtcctgtcggtctcgcgccccatggcggcgatgaaggccggcgccgaggtcgaggtcgagtacgacgtcccggaggacgcgtggtacttcgacgagaacgcgagcctcacgatgccgttcgcggtggtgctcgaggccgcgctccagacgtgcggctggctcgcgagctacgccggctgcgcgctctcgaccgacggcgcgctgtacttccgcaacctcgacggcaagggcacgctgcacgccgaggtccttccggcgccggcgccggcagtgagcgcgctgcgcaccaggtcgcggctcacgaacatgtcccggtcgggcggcatgatcatcctctcgttccgggtcgagtgcagcctcggcggcgcgcgggtgtacgagctcgacacggtgttcggcttcttcccgaaggccgcgctcgcgacgcagatcgggatcccgccgaggcccgaggaggtcgccgcgctcgatgagccgtccgatttcgaggtcgatctccgcgagcgccccgcgcggtactgcggcggcaagctcgggctcgcgcggccgtcgctgctgatgatcgaccggatcgacggcctgtggcaggccggcggccggaaggggctcggccggctccgcgcgcggcgggacgtccacgcgtcggagtggttcttcaaggcccatttcctgggcgatcccgtgcagccaggctcgctcggcatcgaggcgatgctgcagacgatccagttctggatgctgcaccaggacctccacgcgggcctgcgcgatccgcggttcgagcccgtgatgacggggcacgagcactcctggcggtaccggggccaggtgctgccggccagccgacgggtgacggtcgacaccgacatcctcgaggtcggccgcgacgaccgcgggccctacgtcatcgccgagtcctacctctgggtggacggcctgcgcatctacggcgcgacgctcggcgtgaggatcgtcgacggcgcctcgtcccgagcgcggcgcgacgtcggcttcgacccgcgcgcgagcgcgcgccgcctcgcgtcgctccccggcgccgtaggcgggagcccgcgcctgcgcccgcaggagccgcccgcggcgaaggccgcgccggcggcgctcgacgacgct

SEQ ID NO: 58 - protein, 915 aa, Sorangium cellulosum
  SOURCE 1..915: /mol_type="protein" /note="This sequence is generated from feature [CDS]: 1..2745 placed under sequence number 57" /organism="Sorangium cellulosum"
PRLVRAEPPQPARAEPPRSFEPRVVEPRVVEPPRPAAAPPAPRPAAQPELPAASSLAPRGPRFSREQLEHLASGRISDVFGPLFARQDAYRRQVRMPMPPLLLADRVTGIDAEPGSMKLGTMWTETDVRWDSWYLHDGAMPAGVMIESGQADLLLISWLGADFENKGERVYRLLGCELTFYGGLPRPGDTLVYDIHVDGHAKHGDVRLFFFHYDCRIGGELRLKTRKGQAGFFTDEELASSGGVLWDADTAEHATTARLDPPRIACQKSAFDRADLLAFAAGDGAAAFGPAFDRLSTHVRTPRISAPPMLFFDRVDVFDPAGGPWKRGYLRATLPITKDGWYFEGHFKDDPCMPGTLMFEGCLQALAFYMAAMGFTVDADGFRFEPVPEIPYLLRCRGQVVPTSRVLTYEVFIEEVHDGPCPTVFADFLCTVDGLKAFHARRVGLRLSPDWPLTSAPELLDGHVEPVPVARVPWSETGAPPPDGAAADAGGFPFDYRSLLSCAWGRPSDAFGPLYRRFDAGQHVARLPGPPYHFMSRVLSVSRPMAAMKAGAEVEVEYDVPEDAWYFDENASLTMPFAVVLEAALQTCGWLASYAGCALSTDGALYFRNLDGKGTLHAEVLPAPAPAVSALRTRSRLTNMSRSGGMIILSFRVECSLGGARVYELDTVFGFFPKAALATQIGIPPRPEEVAALDEPSDFEVDLRERPARYCGGKLGLARPSLLMIDRIDGLWQAGGRKGLGRLRARRDVHASEWFFKAHFLGDPVQPGSLGIEAMLQTIQFWMLHQDLHAGLRDPRFEPVMTGHEHSWRYRGQVLPASRRVTVDTDILEVGRDDRGPYVIAESYLWVDGLRIYGATLGVRIVDGASSRARRDVGFDPRASARRLASLPGAVGGSPRLRPQEPPAAKAAPAALDDA

SEQ ID NO: 59 - protein, 915 aa, Sorangium cellulosum; identical to SEQ ID NO: 58
  SOURCE 1..915: /mol_type="protein" /organism="Sorangium cellulosum"

SEQ ID NO: 60 - DNA, 2106 bp, Sorangium cellulosum
  source 1..2106: /mol_type="DNA" /organism="Sorangium cellulosum"
  CDS 1..2106: /codon_start=1 /gene="domain IV*" /transl_table=11
gaagaggtgctggacccggacgggtgggtggcggaccatcgccccacgtggacgctcccggcgctccccgggatgagcatggtcgaccggctggccggcgcagcgttgcgggcgcgcccggggagcgtggtcgtggccgtggaggacgtggtggtgcagcgctggctgcccgtgccggggccggtgcgcgtcaaggccgaggcgaccggctcgggcgacgtcctcgatgtccggctgctcgcgtggcgcgaggcatcgaacccggcgctctcgcggttcgagcccgtgtgcaccggccgcgttcgggtggcccgtgactacccgcccgccccggcgccggagccggcgctcgacgcgcctgaggcggacgatccgtacgcggcggggacgctgttccacggccctgcgttccagtacctgacctcgctcaggctcggcgcgcgcggctcgtcggcggtgctggacccccggaggggctcggtgcccccagggacgctgcaccagggcatgctcgacgcgctgacccacaccatcccgcacgatcggctgtcgctgtgggatccagggtgcccgcccgcccagatcgcgttcccgtcgcgcatcccgtcgctccgcgtgtacgggccggcgcccgggtcgccggtgcgcgtggaggtgcgttacgagggccgtgacgatcgcttcgtctcgttccgggtgcaggccatcgcgcaggccggggccgaggtcggggccgcggcgggagagcgcgtctggctggagctccggcttgtcgaggtgctgctcccgcaggggccgatcggcggcgcgccgcccgggatccgccgggcgttcctgcgcgatcgcgcgccggtcgacctcgccgtctcgcgcgtcgacgcggcgtcgggcgaggcgcgctgcagccccgccgacgtgcgcacgatggactggatgcccggcaccgtggcgcagctctacgccgcgtcgggcgacctcgtcgaggcggcggccgtgaaggatcacgtcgcgcggcgcgcgggcgtgcacccgtcgaccgtgtccctcgccggcgtctcgtcggcgcagccgctgacgcgctggccgttcaccgtggcgcgcgagggctccgaggtcgtggtccgcgacgcgggcccgcccgtgatcgacatcgcgccggtccgccgctactggggcgcggccatgggcatcggccggtggccggcggaggacctctacttcgggctcatcgagcggttcatccgccgggtgcacgtcgtcgatcccgcggcgttccgcgccgtgaagggccggagcctgctctacctcggcaaccaccaggtcggcgtggagtcgctgctgttcggcatcgccgtgtccggcctgacggaggtctcgacggtcacgctggccaaggccgagcaccggacgacgtggctcggcacgatgctggcgcactgcttcgcgtatcctggcgcgcgcgatccgaaggtgatcacgtacttcgatcgcgaggacaaggcgtcgctcgggaccatcatcgccgagctcggggccgagatgcagggggccggcaagggcgtgatggtgcacgtcgagggcacgcgatcgctcgagtgccgcacgccggtgcgcaagatgagcggctcgttcatcgacatggcgctcgcggtgggcgtcccggtggtgcctgtgcgcttctccggcgcgctgccgccggagccgctcgagcggcggctcgagttcccgctcggcatgggcgtgcaggacatctggatcggccgcccgctgctgcccgaggagctcgcggggctgacctacaaggaccgcaaggacctcgtgatcagcggcatcaacgggctcggcccgagcaacgcggtcgagcagccgttccccggggatcctgcgttcgcggcgtcggtggacgcctgggtggaggaggcgggcgtcgcgcacgaggacgcgacggtcttccgggtgctgcaggcgtgcgccgacccgacgccggagacggccgcgatcctggaggccgcgcgcacggggcggctcgtcgcgcccgacgcgcggcgggcggactggctgcggaagctcgcggcgcggctcctcgggaggcggctcggggggtga

SEQ ID NO: 61 - protein, 701 aa, Sorangium cellulosum
  SOURCE 1..701: /mol_type="protein" /note="This sequence is generated from feature [CDS]: 1..2106 placed under sequence number 60" /organism="Sorangium cellulosum"
EEVLDPDGWVADHRPTWTLPALPGMSMVDRLAGAALRARPGSVVVAVEDVVVQRWLPVPGPVRVKAEATGSGDVLDVRLLAWREASNPALSRFEPVCTGRVRVARDYPPAPAPEPALDAPEADDPYAAGTLFHGPAFQYLTSLRLGARGSSAVLDPRRGSVPPGTLHQGMLDALTHTIPHDRLSLWDPGCPPAQIAFPSRIPSLRVYGPAPGSPVRVEVRYEGRDDRFVSFRVQAIAQAGAEVGAAAGERVWLELRLVEVLLPQGPIGGAPPGIRRAFLRDRAPVDLAVSRVDAASGEARCSPADVRTMDWMPGTVAQLYAASGDLVEAAAVKDHVARRAGVHPSTVSLAGVSSAQPLTRWPFTVAREGSEVVVRDAGPPVIDIAPVRRYWGAAMGIGRWPAEDLYFGLIERFIRRVHVVDPAAFRAVKGRSLLYLGNHQVGVESLLFGIAVSGLTEVSTVTLAKAEHRTTWLGTMLAHCFAYPGARDPKVITYFDREDKASLGTIIAELGAEMQGAGKGVMVHVEGTRSLECRTPVRKMSGSFIDMALAVGVPVVPVRFSGALPPEPLERRLEFPLGMGVQDIWIGRPLLPEELAGLTYKDRKDLVISGINGLGPSNAVEQPFPGDPAFAASVDAWVEEAGVAHEDATVFRVLQACADPTPETAAILEAARTGRLVAPDARRADWLRKLAARLLGRRLGG

SEQ ID NO: 62 - protein, 701 aa, Sorangium cellulosum; identical to SEQ ID NO: 61
  SOURCE 1..701: /mol_type="protein" /organism="Sorangium cellulosum"

SEQ ID NO: 63 - DNA, 16219 bp, Aetherobacter fasciculatus
  source 1..16219: /mol_type="DNA" /organism="Aetherobacter fasciculatus"
  CDS 1..1608: /codon_start=1 /product="pfa1" /transl_table=1
  CDS 1644..8312: /codon_start=1 /product="pfa2"
  CDS 8309..16219: /codon_start=1 /product="pfa3"
gtgtctgcaatcggtagatggaacgctcaagggggctcgccggagctcacccctgcggcgatggtcgcggcgatagcgcgttgtcgagagtcgttgcacgtggtgcgcgacggggagtccgggcggatcggcctgggcgtggggggcgagctgctcccccccggcgagcgccgcgcgggcgagtacacgcttgtggcctcgctgccgccgctgttccccgagtggctcggtgaccgctcgttctgcgaggtgcacggggtccgcttcccctacgtcgccggcgagatggccaacggcattgccaccgtggagatggtcgtggccatgagccggagcgggatgctcggcttcttcggcgccgcgggcctgggcttctcccgggtcgaggccgcggtggagacgctccgcgccacgctgggggacgaggcgccgtggggggtgaacctcatccactcaccgaacgaggcctcgctggagaaccgcgtcgccgatctgctgatcgagagcggggtgcggcgcatctcggtgtcggccttcatggcgctgacgccggcggtggtgcgctgcgcggcgcgcgggctgcggctcgacgcggcggggcggatcgtgcggccgcggcacatcttcgccaagctctcgcggcgcgaggtggcgctgccgttcctctcccccgcgccggaggagatgctgcgcgccctcgtcgccagcggcgggttgacggaggaagaggcccgcctcgccgcgaagatcccggtggccgaggacatcaccgtcgaggccgactccggcggtcacaccgacaaccaggcgctggtggcgctgctcccgacgatcttgcagctccgcgacgagctggcggacaagtacgactacacgcggccgatccgcgtcggcgcggcgggtgggctcgggacgccgacggcggtcgccgcggcgttctcgctcggcgcggcctacgtcgtcaccggctcggtcaaccaggcggcgctggagtccggcctctccgacgagggcaagcggatgctggcgcaggccgaggtcgccgacgtgatcatggcgcccgcggccgacatgttcgagctcggggtcaagctccaggtgctgcggcgcgggagcatgttcggcgtgcgcgcggccaagctctacgaggcgtaccacgcgcacccctcgctcgaggccatccccgacgcgctgcgggcgcggctcgagcgcgaggtcttgcacgcgaccttcgacggcatctgggcggagacgcgggccttctgggaggcgcgcgatcccgagcaggtcgcgctggcggcgcgggatcccaagcaccggatggcgctggtcttccgctggtacctcggcatggcgagccgctgggccatcgccggcgaggcgtcgcggcgggccgactaccagatctggtgcgggccggcgatgggggccttcaactcctgggtccgcggctcgttcctcgaagatcccaagcagcgcggcgtggtggcgatcgcgctcaacctgctcgagggcgcggccgtcgtcacccgcgcccaccagctccgcacctacggcgtgcccgtgccggccgccgcgttcgactttcgacctcgtccgctcgcttgagcgctcggcttcaccttcactcgacaggtcttcgcatgactcaggttccggtcgccatcgtcggcgtgggcgcgctctttccgggctcgcccgacggtgcaggcttctggcgcgacatcgtcgcgtcacgcgatctcgtctccgacgtccccccggggcactggctgatcgaggactactacgatcccgatccctcggcgccggacaagacctactccaagcgcggggccttcctcggcgagacggccttcgatccgctggagttcggcgtggtgccgagctcgctcccgaccaccgacaccgcgcagctgctggcgctgatcgtggcgcggcgggtgctcgacgacgcgacccaggggcgcttcgcttccatcgatcgatcgcgcatcggcgtcgtcctcggcgtgacctcggggcaagagctcctcggcacgatggtgagccggctccagcggccggtgtggctcaaggcgctgcgcgacgacggcgtgcccgaggccgacgcgcagcggatctgcgatcggatcaccaacgagtacgtgccctggaaggagtcgacgttccccgggctcctcggcaacgtggtcgccgggcgcatcgccaaccgcttcgatctcggcggcaccaactgcgtcaccgacgcggcgtgcgcgagctcgctcgcggcgctctcgatcgccatgaacgagctggcgctcgggcagtcggatctcgtgatcaccggcggggtggacacgatgaacgacatcctgatgtacacctgcttcagcaagaccccggcgctctcgaagtcgggcgactgccgccccttctccgacgccgccgacgggacgctgctcggcgagggcctggcgatgttcgcgctcaagcgcctcaccgacgccgagcgcgacggggatcgcgtctacgcggtgatccgcggcctgggatcgtcgtcggacgggcggagcaagagcgtgtacgcgccggtgccggaagggcaggccaaggcgctggtgcgggcctacgaggcggccggctacggcgcggacacggtggagctggtcgaggcgcacggcaccgcgaccaaggccggcgacgcggcggagttcggcggcctcaagctggcgttcgaggcgagcgggcgcgcggatcaccagtggtgcgcgctcggatcggtgaaatcgcagatcgggcacaccaagtcggcggccggcgcggcgggcctcttcaaggcggtgatggcgctgcaccacaaggtcctgccgccgacgatcaaggtcgatcgccccaaccccgagctggcgatcgaggcgagcccgttctacctcaacacgcaggcgcggccctgggtgcgcaacgcgcagcacctgcggcgggcctcggtctcgagcttcggcttcggcgggagcaacttccacgtgacgctggaggagtacgccggcacggcggagccggcggcgcgcctgcgcacggcgccgacggagctcttcgtgatctcggcgccctcggcggcggaggtcctcgcgcgcgccggcaagctcgccgagctcgcggacaaagagggcacgacgacggcggcgcggacctcgcagcgcgacttcgtgacggcggatcacgcgcggctctccatcgtggcgagcgacgccgcggatctgcgcgccaagctcgagcaagcgcgctcgctcctgtcggcgcgccccgaggaggcgttctcgacgccgaccggcgtccacttcgcggtgggcgcggcggcgggcggcgtggcgttcctcttccccgggcaggggagccagtacgtgggcatgggcgccgacgtggccatggagcacggcgtcgcgctcgacgcgtgggacgcggcggcgggcctggtcgagaccgcggggctgcgcgacgtggtcttcccgcgcccggccttcaccgacgaggcgcgagccgagcaggcgcagctcttgacggcgaccgagtgggcgcagccggcgatcgccacggcgagcctcgcgctcctcgcggtgctgcgggcggtcggcgtccgcccgtcgagcgtcgccggtcacagcctgggcgagctcaccgcgctcgccgcggccgatgctttgagcaccaacgatctcgtggccacggcgcgcaagcgcggccagctcatgaacgcggcgtcgagcacgccgggggcgatgaccgcggtggcgcggcccctcgccgaggtgcaggccctcctcgagcgcctccagagcgaggtggtggtggccaaccacaaccacccgacccaggtcgtcctcgccggcgagaccgccgcgatcgaggcggtcgaggccgagctcgcgcgccaggggatcaccgccaagcggctcccggtcgccacggcgttccacagccaggtcgtggccggggcgacggcgcccttcgccgagcacctcgccgggatcgcggtgaaggcgccggccatcgacgtgctctccaacagcgaggccgcggcctacccgtcggatcccgacgcggtgcgcgcgctcctcgccgggcagatcacgcgctcggtccgcttcgtcgaggtggtcgaggcgatgtgggcgcgcggggcgcgcatcttcgtggaggtcggcccctcggcggtgctgaccgagctctgcgcgcggatcctcggcgagcggccgcacctggcgatcgccatggatcgcaagggcaagcacggcgtgaccgcgctccaggacgcgctcgggcgcctcgccgcggccggcgtggccatcgacttcgccccgctgtgggcgccgttcggcccgcccgcggcgccgaagcgggtgccggcgatgtcgatgatgatcaacggcgcgaactacgggaaggtctacccgcccaagggcggcgccgcggcgctgccgccgccgaacccgccgcgcccggtcgttgctgctgcaacgatcgccgcggcgccgagctcggcggccaaggctccggtcgttgctgctgcaacgatcgcggcggcgccgatcccggcggccaaggctccggtcgttgctgctgcaacgatcgcggcgcgccccgcggcggcgcccgagtcgcggccggtcgtcgcggctgccccggcccctgcgccggttgtggcggcgcccgcgtcggcggcggcggcgctgtcggcgccgggtcagctcggctggatcgaggcgtaccaggagtcgcagcggcagctcaccgaggcgcacgcgtcgtacgtgcggacgatggcgtcggggcacgaggcgttcctcacgacgatggaggcctcgttcatcgggctcggcggcctgctcggcgcgccggcttcggtgtccgcggtcgccccgcggagcgcagcggctccggtgctcgcgcagccggtcgcggtcgctccggctccggtgctcgcgccggctccggtgcccgcgcccgctccgactccggtgctcgctccggctcccgctccggtgctcgcgcctgcgcctgtcgccgcggtggcgaaggcggctcccgcgccggtgatggcgcccgcggcgccgtcaatcgatctccaggcgctgctgctcgacgtggtcgcggacaagaccggctaccccgccgagatgctcggcatgcacatggagctcgaggccgatctcggcatcgactccatcaagcgcgtcgagatcctctccgccatgcgcaagcgcgcgcccaacctcccggaggtcgtcgcctccgagatggccacgctccgcaccctcgggcagatcgtcgagtacatgcgcgagcggtccggtgcgctgacggctgcgactcacgagacgctggttcccgcgacggcagaggctgcgacccaggcggctccggcgctcggcgatctccaggcgctgctgctcgacgtggtcgcggacaagaccggctaccccgccgagatgctcggcatgcacatggagctcgaggccgatctcggcatcgactccatcaagcgcgtcgagatcctctccgccatgcgcaagcgcgcgcccaacctcccggaggtcgtcgcctccgagatggccacgctccgcacgctcgggcagatcgtcgagtacatgcgcgaccgctccggcgcgacggcggctccggtgaaggcagcgcctgcgcctgcgcctgcgcctgcggcggctccgacgaaggaagcgccgacgctggcggatctgcaaacgctgctgctcagcgtcgtcgcggacaagaccggctaccccgccgagatgctcggcatgcacatggagctcgaggccgatctcggcatcgactccatcaagcgcgtcgagatcctctccgccatgcgcaagcgcgcgcccaacctcccggaggtcgtcgcctccgagatggccacgctccgtacgctcgggcagatcgtcgagtacatgcgcgaccgctccggcgggcacagcgtggcggccacgacaccggcaccggctccggcctcgactctcgctccggcggcgagccggatcggtcgctacgtggtgggcacgcgcgaggaggcggcgagcgggctggcgatgggcggcgtgctcggcgcgcggcgcttcgtcatcaccaacgaagggacgggcatcgcgcaggcgctggtgcgggcgctgcaagagcgcggcgtcagcagcgaggtcgtgaccgaggtgccggcggacgccgacgcggtggtgttcctcggcgggctccggaccctcgtcgacgtcgacacggccatcgcgatcaaccgcgaggcgttcctcgcggcgcgcgctgtggccagtgtgttctcgcgcgacggcggcgccttcgtgacggtccaggacacgggcggcgatctcgggatcgaggcgcgcgagccgcgggcagcgtggctcgcgggcgtggccgcgctggcgcggacggcgcagctcgagtggccgaaggcctcggtgaaggccgtcgacgtcgagcgcggcgggcgcagctccgaggagatcgccgcggcgatcgccgaggagatcctcaccggcggcggcgcgctcgaggtcggcctgacggcggccggcgcgcggcgcgtccccgaggtcgtgcagcgcgcggtgggcgagcggaccccggtcctcgctcgcagctcggtcgtcgtcgcctccggcggggcccgcggcgtcaccgccacggcgctgatcgcgctggcgcgccacgcgcagccgaagctggtgatcctcgggcgatccgcgctcgaggcggagccggcggcctgcctcggcgtgcgcggcgacgcggcgctcaagcgcgccttgctcgaggacgcgcgcgcgcagggccggacggcgaccatcgccgagatcggcgcccacgtggcgcgcatctccgcgagccgcgaggtgctggagacgctcgcggcgatcaaggccgcgggcggcgaggcgcgctacctcgccgtcgacgtcaccgacgccgatcgcctccgcctcgcgctggaagaggtccggcgcgactggggcccgatcaccgccgtcgtccacggcgccggcgtcctcgccgacaagcggatcgaggacaaaacgcccgagcagttcgatcgggtcttcgacaccaaggtcctcgggctgcgcgcgctgctcgccgcgaccgagggcgatccgctgcgcgcgatcatcctcttctcctcggtcgccgcgcgcgcgggcaacgtcggccagtgcgactacgccatggccaacgagatcctcaacaaggtggccatcgccgagcggcggcggcgcggcggcgcgtgcaccgtcaagtccctcggctggggcccctgggagggcgggatggtgacgcccgcgctcaagggtcacttcgaatcgatgggcgtggcgctgatcccgctggccgagggcgccgagcacttcatcgccgagatcgagggctccgccgacgagatcgagctggtgatcggcggcggcgccgacggcagcgccatccgcggggacgccgagccgacgatccacttcggggtctcggtctcggatcgcacgagcccgtggctcgccgatcaccgcgtcgctggtcgccgcgtcatccctgtcgccgtcgtgatcgagtggttcacccgcgcggtcacggcgctccagggccgcgccgcggtgagcctccgcgacgtcaaggtgctgcgcgggatcaagctccccgccggcgacgccgcggcctcgttctcgatcggctgccgcaagctcgccgagggcaagatcgagctcacgctccacggggccgacggcgccctgcactaccgcgcgagcgccgagccccggggcgcggcgctgaagcccgagggcgccgcgcctccgctcgcggcgtggggcgatcggccgatctacgacggcgggctgctcttccacgggccgcgcttccacgcgatccacagcatcgagggcgcctcggccgaagggatccgcgccacgctcaccggcgcgcgcgagctcggctggccgggcgaagcgcagcgcaccgatccggcgatcgtcgacggcgcgctccagctcgcgctgctctggacgcgcgagcgcctcggtcaggcctcgctcccgatggccatcgcggccttcgactggcaggcctcggggccggtcgaaggtccagtgcgcgcggtcgttcaagggcgcgaggccgacagcgctcatgcggtctgcgacgtgtggctcgaggacgcgcgcggcgcgatcgtcggcgcgctccgcggcgtcgagaccatcgtgcggcccgccgaggtccgcgcgccgcacctcgtggagacagggccggcctcgtgaccttcgaaccgatcgcgatcgtcgggcaggcctgcacgctccccggcgcgctgacgccggaggcgctgtgggccaacgttctccgcggcgagagcgccgtgacctcgccgccggagggccgctggcgcctcccggcgtggcacgcgatggggaagccgggcgcgcaggaagagcgcgcctggtccgacgccggaggctatgtccgcggcttcgaatcggccttcgatcccggcggcctgcgcctcccggaggccgagctccgcggcctcgatccggtgttccagtggacgctccacaccgcgcgcgcggccctgcgctccgcggggatggaggggccgtcggcgcgcgccgggctcgtcctcggcaacctctcgttcccgacggcgtcgatgtcgcgctacgccgagagcgtctggctcgaggcgctgggcaaggagctcctcggcgggcgcgccgcggcgcaggccggcgtcacccaccccgacgcgcacaaccgcttcatgtccgggctccccgcgcacctcgccgcgcaggccctcgggctcggcgggggcgccttcgcgctcgacgccgcctgcgcctcgtcgctctacgcgatcaagctcgcctgcgaccggctccaggatcgcgctactgatctgatgctggccggcgccgtcaacgccgccgacagcctcttcctccacatcgggttctcggccctctcggcgatgagccgcaccggccagtcgcgcccgtttcaccgcgaggccgacggcctcgtcccctcggagggggccgtcttcttcgcgctccagcgcctcgacgacgcgcgcgccgccggccgccgcgtcctcgggatcatccgcggcgtcggcctctccaacgacgggcgcggccgcggcctcctcgcgccctcggaggagggacagatccgcgccatgcgcctggcctacgccgcggcggggctcacgccctccgacgtgagcttcgtcgagtgccacgccaccggcacgcccgtcggtgacgccaccgagatccggagcctcagcgaggtcttcgccgggtgccgcgacgtgcccatcggctcgctcaagtccaacctcggccacctcatcaccgccgcgggcggcgccggcttgatcaaggtcctcggatcgttcaccgccgaaacgatcgcgccgacgatccacgccggcgcttcgatccccgagctcgccgggtcgccggtccgcctcgtcacgcaggccgagccctggcgcgcggcgggccgccgcatcgccgcgatcagcgccttcgggttcggcggcaacaacgcccacctgatcgtcgagcaggacgacggccgcgccacggcgccgcgggccgcagcgccgcgatccgcgccggcgccgatcgccgtcatcagcctcggcgccaggatcggcgacaccaccggccgcgacgaggccgcgcgcgcgctgctctccggcgcgggctggggcagccgccgcgaggcggtcacggtcgagctcgaggggctgcgcttcccgccgcgcgatctcgagcagacgctcccgcagcagctcctcgtgctcgaagcggggcgcgaggcgatccgcgggctctcgctcccgcgcgatcgcaccgccgtgctcatcggcatgggcgccgatcccgaggtcgcgcgctacggcgctcgctggcgcctgcccgcgttcgccgacgcctgggcggccgccgggctccccgtgtccagcgcctggaccgaggccgcgcgcgacgccgtgcaagagcagcacggcgcggccggcgtcgtcggcgccatgcccaacatcccggccaaccgcctcagcagccagctcgatctcgccgggccgagcttcaccatctcctcggaggagctctccggcgtcgtcgccctgcagctcgccgcgcgcgcgctgcgcagcggcgagatcgacgcggccctcgtcggcgccgtcgatctcgccgatcagatcgtccaccgcaaggcgctgggcgagctcggcctcgagccccgcgccggcgacgccgcggtcgcgctcgtgctcaagcgcctcaccgacgtgcgcaagagcgagaaggtcctggcgatcctcgacgagggcatcgtggacgcgtccagcgatcccgcgcgcctccgcgtcggcgacggcggcgccgatctcgatcccttcgccaccacgggcaagccgcacgcggcggcgggcctcgtccacgtcgccgccgccgtgctcgcgctgcaccacggcgcgcgccccgcccccgggcgcgcctccatgccctgggtcggcccccgccacgccgaggtgacgacgcaggccctcggcgatcaggcggcgacgatccacctccgcggcggcggcctcgccgcgccgctgctgctcgacgccacgccgcagatccatgtcttcgccggcgccgatcgcgaggccgtgctccgcgccctcagcgacgggcgcgagggcctcgacggcccggcgcgcgcggtgatcgtggccggctcgcgcgaggagctcgaggcgcgccgcgccgacgccctccgcgccgccgagcgcaacgcccccatgcccgacggcgtcttcctccgcgatcgccccgtcgcgggcgagctcgccttcgtcttcgcaggcgccgccgcggcgtacccgagcatgggccgcgccctcgcgctcgcgctccccgacgtgatggcgcgcctcggcaaccggctctcgacgctgcccgcggtgatcgactggatccacggcgcgccccgcgagccgcgccacccgctcgagcagctctgggcgtcgtcgttcctctgccagctccacgccgagatcacccgcgtcgacctcgggctccgccccagcgcgaccatcggctactcctccggcgagagcaatgcgctcttcgccatgggcgcctggcgcgacctcgacgccatgatgcacgaggcctggaccgagccgctgctgaccacggagctcgtcggcgactacgccgcggcgcgccgcctctgggcgcgctccggcgtcaccagccccgcggcgacgtgggccgcgtgggtcatcgccgcgcccgtggacgacgtgcgccgcgccctcacgggcgagccgctcgcgcacctcaccatcatcaacaccgccgaggagtgcgtgatcggcggcgaggcctccgcgtgcgaacgcgtcgtcgcgcggctcggcaagaacctcgcgctgccgctcagctacgccatggcctcgcactgccccgaggtcgccgaggcgcgcgaggcgtggatcaagatgcaccgccgcgccaccttcgacgtccccggcgtgcgcatctactccgccggcgccgagcaggccttcgcccccaccgccgacgccgccgcgatggccatcaccggccaggccgtcgacacgctcgatttcccccgcgtgatcgagcgcgcctacgccgacggcgtccgcgtcttcgtcgagcacggcccgcgcggcctctgcagccgctggatcgcgcgcatcctcggcgcgcgcgagcacctcgtcgtcccgctcgacgtcgccgggcagcagccggtccgccagctcgtgagcgccgtggcccagctcatcgccgccggcgtgcccgtcgccgccgacgccctcctcgccaggctcgcgccgcctcccccggcgcgcgcctcgggccccacgctcaccgtgcgcgctcaccctcctgacattcacttcccgacggcccctgccatgcaactgatgccgcccgcgccccttctcccgccggtgctcgccgacaaccccgcgccgcgcacggagcggagcttcaccgggcggtcggcgctgcgagaggacgcgcccgacggcgtcccctcgcctcgcctccccgtgttcgcgaggctcgcgccggtgttcacccacaccgagccggtgttcacgcacgtcgagccggcgctcgcgagccctgagccggcggtcacgcaccccgagccggtgatcgcgcacgccgagccggcgctcacacacgccgagcccgcgctcgcgagccccgcggatggccagcacgcctccatcgccgcgcgcggcgccgccgtgagcgcggggatcgccgccgcccatcgcgcctacgtcgaggcgcaaggcgccgtgcacgcccgcttcctcgcgctctcgggctccttgctctcgcgcctcgccgccgccccgacagccgccgccttcccggcgcctgctccctcgctcgcgccgcagcccgccgccctcccggcgcccgctccgcaggccgccccgccgcagcgcctcaccgcccccaccctcgtggtcgctcggccggtcgcgccgcccgccccgacgccggtgcccgccgccgtggccgcgttcgctcccgcgccgatctcggctccggcctccaccctgcccgcgccgtccctgctccgctccacgctccccgggcccaagttctcgcgcgcggatctcgaggtcctggcctcgggctcgatctcctcgatcttcggcccccagttcgccggccaggatggctatgccaaacaatgtcggatgccggagcccccgctcctgctcgccgatcgcgtcactggcatcgacgctgtccccggctcgatggacacgggcaccatctggaccgagaccgacgtcaagcacgacagctggtatctccaccagggccggatgccgactggcatcgtgatcgagtccggccaggcggatctcctcctgatctcctggctcggtatcgacgccctcaacaagggggagcgcgtctatcgcctcctcggctgcgaggccacctatcacggcgagctgccaaagccgggcgacacgctcgtctacgagatccacatcgacggccacgccgagcagggcgacgtgcggctgttcttcttccactacgactgccgcatcaacggcgagctgcggatctcggtgcgcaacggccaggccgggttcttcacctatcaagagctcgccaactccggcggagtgctctgggacgccgacggcgcgccccacgaggcgacaggccccctcgatccgcctcaagtgatctgcgagaagcagtccttcacctcggccgaggtcctcgccttctccgagggggacgcctacgcctgcttcgggcgcggcttcgagcgcgcgcagacgcacgtgcgcacgccgcgcatccaggacgggccgatgcggctcctcgatcgcgtcacccacttcgatcctcgcggcgggccctgggggcgcggctacctgcgcgccgaggccaagctctcgcccgacgactggttcttgcgagggcacttcaagaacgatccctgcatgccagggacgctgatcctcgaggcctgcgtgcaggccatggccttctatctctgcgccatgggctactccatcgatcgcgacggctggcgcttcgagcctgtccccggccagaagagcccgatgcgctgccgcggccaggccagcgtgacctcgcgggagatcgtctacgagatcttcgtccacgaggtcacgagcgggcctatccccagcgtcaaggtcgacatgctctgcaccgtcgacggcctcaaggccttccacggcgagcgcgtcggcctgcgcctcgtccccgcctggcccctcgacgactggcgacaggcccccgtcgccccgcagagcctgcaccgccgccccaagcagatcgcccctctcggcgggatcctcggccacgtcgagacccggccggtgccctcggtcaacggctttgccttcgactacgcctcgctcatcgcctgcgcctggggcaagccctcgcaggccttcgggccgatgtacgcgcccttcgacggcactcgccgcgtcgcccgcctgcccgggccgccttatcacttcatcacgcgcatcatctcggtcgagggcccgatcggcgtcccccagcccggcgccgaggtcgaggtcgagtacgacgtcccccacgacgcctggtatttcgcggagaacggcgcgcgcaccatgccgttctgcgtcctgctcgaggccgcgctccagccctgcggctggctggcgagctacatcggcagcgccctcaccaccgaggacgatctgctcttccgcaacctcgacgggactggcaccgtcctcgcggagatcacccccgagtccggcacgctgcgcacccacgtcaaggtggtcgaggtctcgcagtccgcggggatgatcatcgagaccttcgaagtcgagtgcttcgtcggcgaagcccacgtgtacacgctgcgcaccgtctttggcttcttccccaaatcggccttcgacaaccaggtcggactccccgtctccgccgaggcccgcgcccggatcgagcgtcaagccacctcgaccatcgatctggctccggagccgccgcgctacttcgccggcgcccctcgcctccccgaagcgatgctgtgcatgctcgatcgcatcaccgcgttcgagccgaccggcggcctcaagggccttggctatggccgcgccgagaagacggtcaaacccggggagtggtccttcaaagcccacttcttccaggatcccgtccagccgggctccctcggcctcgaggccctgctccagctccttcaggcgtggatgatcgacgccggtgacgccgagggtatcccgggcgcgcgcttcgaacccatcgccgtcggccgcccgatgacctggaaataccgcggccaggtcgtccccaagaacctcctcgtgacggtggagatcgacatcaccgagcgcggcaccgacgatcgcgggcgcttcgccctggccgagggctcgctctgggtcgacggcaagcgcatctacggcgcgaagaacctcggcatgcgcgtcgtcgccggccccgagcgcccgccgcccggctcgccgccttcgcccgcttcgccgaccgcgccgaccgcgcccccttcgccgcctgccccgacggtgccggctgcgctggctgcgccgccttcgcgcgatctcgcctcgtttcgaagcttctggcgcgcctcgatcggggtcgggccctggccgatcgaggacctctacatcgccctggtcgagcgcttcctcggccggatcgtcatcgccgatccggtcgccttctcgcgcgtccacggccgcggctgcctctacgtcgccaaccaccaggtcgcgctggagtcgctgatcttcatcatggtcgcctcggcgatctccggcacgcggacgatggcgctcgccaaggccgaacatcaggagtcgtggctcgggcgcctgatcacccgcggcatcgcctaccccggcgtcaccgatccaggcctcatcaccttcttcgaccgcgaggatcacgcctccttcgcccgcatcgccgagcaggccacgcgcgatctcgcggcctcgaccaagagcgtgctcgtccacgtcgagggcacgcgcgccatctcgtgccgcacccccgtcacccgcctcggcgcctcggtgatcgacatggcgctggccgccggcgcgcccatcgtcccggtccgcttcgcgcgcggcctgcccgagagcgactcccccgagcgcctcgatttcccgctcggctacggccgccaggacatctacttcggcgccccgatcgagcccgccgagctcgcgcgcctcccgctcaaggaccgcaaggacgccttgctcacggccctcaacacgctcggccccggcgcgagcgacacgccctccgaccccgacccgagcttcgccgcccaggtcgaggcctggcgagcccgcaccggctgcgccatcgaagatgccgtgttctatgccaccctcgccggagcgtcagccccggagtcggagggcgtgcagcggttactggagggcgcgagaacggggaagctggttatcgggagtggggagaaggatcgctggctgggggagtttgcgcggagcctgtttggatcggcggatgcgacgctcttggtggagggcggctga

SEQ ID NO: 64 - protein, 535 aa, Aetherobacter fasciculatus
  SOURCE 1..535: /mol_type="protein" /note="This sequence is generated from feature [CDS]: 1..1608 placed under sequence number 63" /organism="Aetherobacter fasciculatus"
VSAIGRWNAQGGSPELTPAAMVAAIARCRESLHVVRDGESGRIGLGVGGELLPPGERRAGEYTLVASLPPLFPEWLGDRSFCEVHGVRFPYVAGEMANGIATVEMVVAMSRSGMLGFFGAAGLGFSRVEAAVETLRATLGDEAPWGVNLIHSPNEASLENRVADLLIESGVRRISVSAFMALTPAVVRCAARGLRLDAAGRIVRPRHIFAKLSRREVALPFLSPAPEEMLRALVASGGLTEEEARLAAKIPVAEDITVEADSGGHTDNQALVALLPTILQLRDELADKYDYTRPIRVGAAGGLGTPTAVAAAFSLGAAYVVTGSVNQAALESGLSDEGKRMLAQAEVADVIMAPAADMFELGVKLQVLRRGSMFGVRAAKLYEAYHAHPSLEAIPDALRARLEREVLHATFDGIWAETRAFWEARDPEQVALAARDPKHRMALVFRWYLGMASRWAIAGEASRRADYQIWCGPAMGAFNSWVRGSFLEDPKQRGVVAIALNLLEGAAVVTRAHQLRTYGVPVPAAAFDFRPRPLA

SEQ ID NO: 65 - protein, 2222 aa, Aetherobacter fasciculatus
  SOURCE 1..2222: /mol_type="protein" /note="This sequence is generated from feature [CDS]: 1644..8312 placed under sequence number 63" /organism="Aetherobacter fasciculatus"
MTQVPVAIVGVGALFPGSPDGAGFWRDIVASRDLVSDVPPGHWLIEDYYDPDPSAPDKTYSKRGAFLGETAFDPLEFGVVPSSLPTTDTAQLLALIVARRVLDDATQGRFASIDRSRIGVVLGVTSGQELLGTMVSRLQRPVWLKALRDDGVPEADAQRICDRITNEYVPWKESTFPGLLGNVVAGRIANRFDLGGTNCVTDAACASSLAALSIAMNELALGQSDLVITGGVDTMNDILMYTCFSKTPALSKSGDCRPFSDAADGTLLGEGLAMFALKRLTDAERDGDRVYAVIRGLGSSSDGRSKSVYAPVPEGQAKALVRAYEAAGYGADTVELVEAHGTATKAGDAAEFGGLKLAFEASGRADHQWCALGSVKSQIGHTKSAAGAAGLFKAVMALHHKVLPPTIKVDRPNPELAIEASPFYLNTQARPWVRNAQHLRRASVSSFGFGGSNFHVTLEEYAGTAEPAARLRTAPTELFVISAPSAAEVLARAGKLAELADKEGTTTAARTSQRDFVTADHARLSIVASDAADLRAKLEQARSLLSARPEEAFSTPTGVHFAVGAAAGGVAFLFPGQGSQYVGMGADVAMEHGVALDAWDAAAGLVETAGLRDVVFPRPAFTDEARAEQAQLLTATEWAQPAIATASLALLAVLRAVGVRPSSVAGHSLGELTALAAADALSTNDLVATARKRGQLMNAASSTPGAMTAVARPLAEVQALLERLQSEVVVANHNHPTQVVLAGETAAIEAVEAELARQGITAKRLPVATAFHSQVVAGATAPFAEHLAGIAVKAPAIDVLSNSEAAAYPSDPDAVRALLAGQITRSVRFVEVVEAMWARGARIFVEVGPSAVLTELCARILGERPHLAIAMDRKGKHGVTALQDALGRLAAAGVAIDFAPLWAPFGPPAAPKRVPAMSMMINGANYGKVYPPKGGAAALPPPNPPRPVVAAATIAAAPSSAAKAPVVAAATIAAAPIPAAKAPVVAAATIAARPAAAPESRPVVAAAPAPAPVVAAPASAAAALSAPGQLGWIEAYQESQRQLTEAHASYVRTMASGHEAFLTTMEASFIGLGGLLGAPASVSAVAPRSAAAPVLAQPVAVAPAPVLAPAPVPAPAPTPVLAPAPAPVLAPAPVAAVAKAAPAPVMAPAAPSIDLQALLLDVVADKTGYPAEMLGMHMELEADLGIDSIKRVEILSAMRKRAPNLPEVVASEMATLRTLGQIVEYMRERSGALTAATHETLVPATAEAATQAAPALGDLQALLLDVVADKTGYPAEMLGMHMELEADLGIDSIKRVEILSAMRKRAPNLPEVVASEMATLRTLGQIVEYMRDRSGATAAPVKAAPAPAPAPAAAPTKEAPTLADLQTLLLSVVADKTGYPAEMLGMHMELEADLGIDSIKRVEILSAMRKRAPNLPEVVASEMATLRTLGQIVEYMRDRSGGHSVAATTPAPAPASTLAPAASRIGRYVVGTREEAASGLAMGGVLGARRFVITNEGTGIAQALVRALQERGVSSEVVTEVPADADAVVFLGGLRTLVDVDTAIAINREAFLAARAVASVFSRDGGAFVTVQDTGGDLGIEAREPRAAWLAGVAALARTAQLEWPKASVKAVDVERGGRSSEEIAAAIAEEILTGGGALEVGLTAAGARRVPEVVQRAVGERTPVLARSSVVVASGGARGVTATALIALARHAQPKLVILGRSALEAEPAACLGVRGDAALKRALLEDARAQGRTATIAEIGAHVARISASREVLETLAAIKAAGGEARYLAVDVTDADRLRLALEEVRRDWGPITAVVHGAGVLADKRIEDKTPEQFDRVFDTKVLGLRALLAATEGDPLRAIILFSSVAARAGNVGQCDYAMANEILNKVAIAERRRRGGACTVKSLGWGPWEGGMVTPALKGHFESMGVALIPLAEGAEHFIAEIEGSADEIELVIGGGADGSAIRGDAEPTIHFGVSVSDRTSPWLADHRVAGRRVIPVAVVIEWFTRAVTALQGRAAVSLRDVKVLRGIKLPAGDAAASFSIGCRKLAEGKIELTLHGADGALHYRASAEPRGAALKPEGAAPPLAAWGDRPIYDGGLLFHGPRFHAIHSIEGASAEGIRATLTGARELGWPGEAQRTDPAIVDGALQLALLWTRERLGQASLPMAIAAFDWQASGPVEGPVRAVVQGREADSAHAVCDVWLEDARGAIVGALRGVETIVRPAEVRAPHLVETGPAS

SEQ ID NO: 66 - protein, 2636 aa, Aetherobacter fasciculatus
  SOURCE 1..2636: /mol_type="protein" /note="This sequence is generated from feature [CDS]: 8309..16219 placed under sequence number 63" /organism="Aetherobacter fasciculatus"
VTFEPIAIVGQACTLPGALTPEALWANVLRGESAVTSPPEGRWRLPAWHAMGKPGAQEERAWSDAGGYVRGFESAFDPGGLRLPEAELRGLDPVFQWTLHTARAALRSAGMEGPSARAGLVLGNLSFPTASMSRYAESVWLEALGKELLGGRAAAQAGVTHPDAHNRFMSGLPAHLAAQALGLGGGAFALDAACASSLYAIKLACDRLQDRATDLMLAGAVNAADSLFLHIGFSALSAMSRTGQSRPFHREADGLVPSEGAVFFALQRLDDARAAGRRVLGIIRGVGLSNDGRGRGLLAPSEEGQIRAMRLAYAAAGLTPSDVSFVECHATGTPVGDATEIRSLSEVFAGCRDVPIGSLKSNLGHLITAAGGAGLIKVLGSFTAETIAPTIHAGASIPELAGSPVRLVTQAEPWRAAGRRIAAISAFGFGGNNAHLIVEQDDGRATAPRAAAPRSAPAPIAVISLGARIGDTTGRDEAARALLSGAGWGSRREAVTVELEGLRFPPRDLEQTLPQQLLVLEAGREAIRGLSLPRDRTAVLIGMGADPEVARYGARWRLPAFADAWAAAGLPVSSAWTEAARDAVQEQHGAAGVVGAMPNIPANRLSSQLDLAGPSFTISSEELSGVVALQLAARALRSGEIDAALVGAVDLADQIVHRKALGELGLEPRAGDAAVALVLKRLTDVRKSEKVLAILDEGIVDASSDPARLRVGDGGADLDPFATTGKPHAAAGLVHVAAAVLALHHGARPAPGRASMPWVGPRHAEVTTQALGDQAATIHLRGGGLAAPLLLDATPQIHVFAGADREAVLRALSDGREGLDGPARAVIVAGSREELEARRADALRAAERNAPMPDGVFLRDRPVAGELAFVFAGAAAAYPSMGRALALALPDVMARLGNRLSTLPAVIDWIHGAPREPRHPLEQLWASSFLCQLHAEITRVDLGLRPSATIGYSSGESNALFAMGAWRDLDAMMHEAWTEPLLTTELVGDYAAARRLWARSGVTSPAATWAAWVIAAPVDDVRRALTGEPLAHLTIINTAEECVIGGEASACERVVARLGKNLALPLSYAMASHCPEVAEAREAWIKMHRRATFDVPGVRIYSAGAEQAFAPTADAAAMAITGQAVDTLDFPRVIERAYADGVRVFVEHGPRGLCSRWIARILGAREHLVVPLDVAGQQPVRQLVSAVAQLIAAGVPVAADALLARLAPPPPARASGPTLTVRAHPPDIHFPTAPAMQLMPPAPLLPPVLADNPAPRTERSFTGRSALREDAPDGVPSPRLPVFARLAPVFTHTEPVFTHVEPALASPEPAVTHPEPVIAHAEPALTHAEPALASPADGQHASIAARGAAVSAGIAAAHRAYVEAQGAVHARFLALSGSLLSRLAAAPTAAAFPAPAPSLAPQPAALPAPAPQAAPPQRLTAPTLVVARPVAPPAPTPVPAAVAAFAPAPISAPASTLPAPSLLRSTLPGPKFSRADLEVLASGSISSIFGPQFAGQDGYAKQCRMPEPPLLLADRVTGIDAVPGSMDTGTIWTETDVKHDSWYLHQGRMPTGIVIESGQADLLLISWLGIDALNKGERVYRLLGCEATYHGELPKPGDTLVYEIHIDGHAEQGDVRLFFFHYDCRINGELRISVRNGQAGFFTYQELANSGGVLWDADGAPHEATGPLDPPQVICEKQSFTSAEVLAFSEGDAYACFGRGFERAQTHVRTPRIQDGPMRLLDRVTHFDPRGGPWGRGYLRAEAKLSPDDWFLRGHFKNDPCMPGTLILEACVQAMAFYLCAMGYSIDRDGWRFEPVPGQKSPMRCRGQASVTSREIVYEIFVHEVTSGPIPSVKVDMLCTVDGLKAFHGERVGLRLVPAWPLDDWRQAPVAPQSLHRRPKQIAPLGGILGHVETRPVPSVNGFAFDYASLIACAWGKPSQAFGPMYAPFDGTRRVARLPGPPYHFITRIISVEGPIGVPQPGAEVEVEYDVPHDAWYFAENGARTMPFCVLLEAALQPCGWLASYIGSALTTEDDLLFRNLDGTGTVLAEITPESGTLRTHVKVVEVSQSAGMIIETFEVECFVGEAHVYTLRTVFGFFPKSAFDNQVGLPVSAEARARIERQATSTIDLAPEPPRYFAGAPRLPEAMLCMLDRITAFEPTGGLKGLGYGRAEKTVKPGEWSFKAHFFQDPVQPGSLGLEALLQLLQAWMIDAGDAEGIPGARFEPIAVGRPMTWKYRGQVVPKNLLVTVEIDITERGTDDRGRFALAEGSLWVDGKRIYGAKNLGMRVVAGPERPPPGSPPSPASPTAPTAPPSPPAPTVPAALAAPPSRDLASFRSFWRASIGVGPWPIEDLYIALVERFLGRIVIADPVAFSRVHGRGCLYVANHQVALESLIFIMVASAISGTRTMALAKAEHQESWLGRLITRGIAYPGVTDPGLITFFDREDHASFARIAEQATRDLAASTKSVLVHVEGTRAISCRTPVTRLGASVIDMALAAGAPIVPVRFARGLPESDSPERLDFPLGYGRQDIYFGAPIEPAELARLPLKDRKDALLTALNTLGPGASDTPSDPDPSFAAQVEAWRARTGCAIEDAVFYATLAGASAPESEGVQRLLEGARTGKLVIGSGEKDRWLGEFARSLFGSADATLLVEGG

SEQ ID NO: 67 - DNA, 1608 bp, Aetherobacter fasciculatus
  source 1..1608: /mol_type="DNA" /organism="Aetherobacter fasciculatus"
  CDS 1..1608: /codon_start=1 /product="domain pfa1" /transl_table=1
gtgtctgcaatcggtagatggaacgctcaagggggctcgccggagctcacccctgcggcgatggtcgcggcgatagcgcgttgtcgagagtcgttgcacgtggtgcgcgacggggagtccgggcggatcggcctgggcgtggggggcgagctgctcccccccggcgagcgccgcgcgggcgagtacacgcttgtggcctcgctgccgccgctgttccccgagtggctcggtgaccgctcgttctgcgaggtgcacggggtccgcttcccctacgtcgccggcgagatggccaacggcattgccaccgtggagatggtcgtggccatgagccggagcgggatgctcggcttcttcggcgccgcgggcctgggcttctcccgggtcgaggccgcggtggagacgctccgcgccacgctgggggacgaggcgccgtggggggtgaacctcatccactcaccgaacgaggcctcgctggagaaccgcgtcgccgatctgctgatcgagagcggggtgcggcgcatctcggtgtcggccttcatggcgctgacgccggcggtggtgcgctgcgcggcgcgcgggctgcggctcgacgcggcggggcggatcgtgcggccgcggcacatcttcgccaagctctcgcggcgcgaggtggcgctgccgttcctctcccccgcgccggaggagatgctgcgcgccctcgtcgccagcggcgggttgacggaggaagaggcccgcctcgccgcgaagatcccggtggccgaggacatcaccgtcgaggccgactccggcggtcacaccgacaaccaggcgctggtggcgctgctcccgacgatcttgcagctccgcgacgagctggcggacaagtacgactacacgcggccgatccgcgtcggcgcggcgggtgggctcgggacgccgacggcggtcgccgcggcgttctcgctcggcgcggcctacgtcgtcaccggctcggtcaaccaggcggcgctggagtccggcctctccgacgagggcaagcggatgctggcgcaggccgaggtcgccgacgtgatcatggcgcccgcggccgacatgttcgagctcggggtcaagctccaggtgctgcggcgcgggagcatgttcggcgtgcgcgcggccaagctctacgaggcgtaccacgcgcacccctcgctcgaggccatccccgacgcgctgcgggcgcggctcgagcgcgaggtcttgcacgcgaccttcgacggcatctgggcggagacgcgggccttctgggaggcgcgcgatcccgagcaggtcgcgctggcggcgcgggatcccaagcaccggatggcgctggtcttccgctggtacctcggcatggcgagccgctgggccatcgccggcgaggcgtcgcggcgggccgactaccagatctggtgcgggccggcgatgggggccttcaactcctgggtccgcggctcgttcctcgaagatcccaagcagcgcggcgtggtggcgatcgcgctcaacctgctcgagggcgcggccgtcgtcacccgcgcccaccagctccgcacctacggcgtgcccgtgccggccgccgcgttcgactttcgacctcgtccgctcgcttga

SEQ ID NO: 68 - protein, 535 aa, Aetherobacter fasciculatus; identical to SEQ ID NO: 64
  SOURCE 1..535: /mol_type="protein" /note="This sequence is generated from feature [CDS]: 1..1608 placed under sequence number 67" /organism="Aetherobacter fasciculatus"

SEQ ID NO: 69 - DNA, 6669 bp, Aetherobacter fasciculatus
  source 1..6669: /mol_type="DNA" /organism="Aetherobacter fasciculatus"
  CDS 1..6669: /codon_start=1 /product="domain pfa2"
atgactcaggttccggtcgccatcgtcggcgtgggcgcgctctttccgggctcgcccgacggtgcaggcttctggcgcgacatcgtcgcgtcacgcgatctcgtctccgacgtccccccggggcactggctgatcgaggactactacgatcccgatccctcggcgccggacaagacctactccaagcgcggggccttcctcggcgagacggccttcgatccgctggagttcggcgtggtgccgagctcgctcccgaccaccgacaccgcgcagctgctggcgctgatcgtggcgcggcgggtgctcgacgacgcgacccaggggcgcttcgcttccatcgatcgatcgcgcatcggcgtcgtcctcggcgtgacctcggggcaagagctcctcggcacgatggtgagccggctccagcggccggtgtggctcaaggcgctgcgcgacgacggcgtgcccgaggccgacgcgcagcggatctgcgatcggatcaccaacgagtacgtgccctggaaggagtcgacgttccccgggctcctcggcaacgtggtcgccgggcgcatcgccaaccgcttcgatctcggcggcaccaactgcgtcaccgacgcggcgtgcgcgagctcgctcgcggcgctctcgatcgccatgaacgagctggcgctcgggcagtcggatctcgtgatcaccggcggggtggacacgatgaacgacatcctgatgtacacctgcttcagcaagaccccggcgctctcgaagtcgggcgactgccgccccttctccgacgccgccgacgggacgctgctcggcgagggcctggcgatgttcgcgctcaagcgcctcaccgacgccgagcgcgacggggatcgcgtctacgcggtgatccgcggcctgggatcgtcgtcggacgggcggagcaagagcgtgtacgcgccggtgccggaagggcaggccaaggcgctggtgcgggcctacgaggcggccggctacggcgcggacacggtggagctggtcgaggcgcacggcaccgcgaccaaggccggcgacgcggcggagttcggcggcctcaagctggcgttcgaggcgagcgggcgcgcggatcaccagtggtgcgcgctcggatcggtgaaatcgcagatcgggcacaccaagtcggcggccggcgcggcgggcctcttcaaggcggtgatggcgctgcaccacaaggtcctgccgccgacgatcaaggtcgatcgccccaaccccgagctggcgatcgaggcgagcccgttctacctcaacacgcaggcgcggccctgggtgcgcaacgcgcagcacctgcggcgggcctcggtctcgagcttcggcttcggcgggagcaacttccacgtgacgctggaggagtacgccggcacggcggagccggcggcgcgcctgcgcacggcgccgacggagctcttcgtgatctcggcgccctcggcggcggaggtcctcgcgcgcgccggcaagctcgccgagctcgcggacaaagagggcacgacgacggcggcgcggacctcgcagcgcgacttcgtgacggcggatcacgcgcggctctccatcgtggcgagcgacgccgcggatctgcgcgccaagctcgagcaagcgcgctcgctcctgtcggcgcgccccgaggaggcgttctcgacgccgaccggcgtccacttcgcggtgggcgcggcggcgggcggcgtggcgttcctcttccccgggcaggggagccagtacgtgggcatgggcgccgacgtggccatggagcacggcgtcgcgctcgacgcgtgggacgcggcggcgggcctggtcgagaccgcggggctgcgcgacgtggtcttcccgcgcccggccttcaccgacgaggcgcgagccgagcaggcgcagctcttgacggcgaccgagtgggcgcagccggcgatcgccacggcgagcctcgcgctcctcgcggtgctgcgggcggtcggcgtccgcccgtcgagcgtcgccggtcacagcctgggcgagctcaccgcgctcgccgcggccgatgctttgagcaccaacgatctcgtggccacggcgcgcaagcgcggccagctcatgaacgcggcgtcgagcacgccgggggcgatgaccgcggtggcgcggcccctcgccgaggtgcaggccctcctcgagcgcctccagagcgaggtggtggtggccaaccacaaccacccgacccaggtcgtcctcgccggcgagaccgccgcgatcgaggcggtcgaggccgagctcgcgcgccaggggatcaccgccaagcggctcccggtcgccacggcgttccacagccaggtcgtggccggggcgacggcgcccttcgccgagcacctcgccgggatcgcggtgaaggcgccggccatcgacgtgctctccaacagcgaggccgcggcctacccgtcggatcccgacgcggtgcgcgcgctcctcgccgggcagatcacgcgctcggtccgcttcgtcgaggtggtcgaggcgatgtgggcgcgcggggcgcgcatcttcgtggaggtcggcccctcggcggtgctgaccgagctctgcgcgcggatcctcggcgagcggccgcacctggcgatcgccatggatcgcaagggcaagcacggcgtgaccgcgctccaggacgcgctcgggcgcctcgccgcggccggcgtggccatcgacttcgccccgctgtgggcgccgttcggcccgcccgcggcgccgaagcgggtgccggcgatgtcgatgatgatcaacggcgcgaactacgggaaggtctacccgcccaagggcggcgccgcggcgctgccgccgccgaacccgccgcgcccggtcgttgctgctgcaacgatcgccgcggcgccgagctcggcggccaaggctccggtcgttgctgctgcaacgatcgcggcggcgccgatcccggcggccaaggctccggtcgttgctgctgcaacgatcgcggcgcgccccgcggcggcgcccgagtcgcggccggtcgtcgcggctgccccggcccctgcgccggttgtggcggcgcccgcgtcggcggcggcggcgctgtcggcgccgggtcagctcggctggatcgaggcgtaccaggagtcgcagcggcagctcaccgaggcgcacgcgtcgtacgtgcggacgatggcgtcggggcacgaggcgttcctcacgacgatggaggcctcgttcatcgggctcggcggcctgctcggcgcgccggcttcggtgtccgcggtcgccccgcggagcgcagcggctccggtgctcgcgcagccggtcgcggtcgctccggctccggtgctcgcgccggctccggtgcccgcgcccgctccgactccggtgctcgctccggctcccgctccggtgctcgcgcctgcgcctgtcgccgcggtggcgaaggcggctcccgcgccggtgatggcgcccgcggcgccgtcaatcgatctccaggcgctgctgctcgacgtggtcgcggacaagaccggctaccccgccgagatgctcggcatgcacatggagctcgaggccgatctcggcatcgactccatcaagcgcgtcgagatcctctccgccatgcgcaagcgcgcgcccaacctcccggaggtcgtcgcctccgagatggccacgctccgcaccctcgggcagatcgtcgagtacatgcgcgagcggtccggtgcgctgacggctgcgactcacgagacgctggttcccgcgacggcagaggctgcgacccaggcggctccggcgctcggcgatctccaggcgctgctgctcgacgtggtcgcggacaagaccggctaccccgccgagatgctcggcatgcacatggagctcgaggccgatctcggcatcgactccatcaagcgcgtcgagatcctctccgccatgcgcaagcgcgcgcccaacctcccggaggtcgtcgcctccgagatggccacgctccgcacgctcgggcagatcgtcgagtacatgcgcgaccgctccggcgcgacggcggctccggtgaaggcagcgcctgcgcctgcgcctgcgcctgcggcggctccgacgaaggaagcgccgacgctggcggatctgcaaacgctgctgctcagcgtcgtcgcggacaagaccggctaccccgccgagatgctcggcatgcacatggagctcgaggccgatctcggcatcgactccatcaagcgcgtcgagatcctctccgccatgcgcaagcgcgcgcccaacctcccggaggtcgtcgcctccgagatggccacgctccgtacgctcgggcagatcgtcgagtacatgcgcgaccgctccggcgggcacagcgtggcggccacgacaccggcaccggctccggcctcgactctcgctccggcggcgagccggatcggtcgctacgtggtgggcacgcgcgaggaggcggcgagcgggctggcgatgggcggcgtgctcggcgcgcggcgcttcgtcatcaccaacgaagggacgggcatcgcgcaggcgctggtgcgggcgctgcaagagcgcggcgtcagcagcgaggtcgtgaccgaggtgccggcggacgccgacgcggtggtgttcctcggcgggctccggaccctcgtcgacgtcgacacggccatcgcgatcaaccgcgaggcgttcctcgcggcgcgcgctgtggccagtgtgttctcgcgcgacggcggcgccttcgtgacggtccaggacacgggcggcgatctcgggatcgaggcgcgcgagccgcgggcagcgtggctcgcgggcgtggccgcgctggcgcggacggcgcagctcgagtggccgaaggcctcggtgaaggccgtcgacgtcgagcgcggcgggcgcagctccgaggagatcgccgcggcgatcgccgaggagatcctcaccggcggcggcgcgctcgaggtcggcctgacggcggccggcgcgcggcgcgtccccgaggtcgtgcagcgcgcggtgggcgagcggaccccggtcctcgctcgcagctcggtcgtcgtcgcctccggcggggcccgcggcgtcaccgccacggcgctgatcgcgctggcgcgccacgcgcagccgaagctggtgatcctcgggcgatccgcgctcgaggcggagccggcggcctgcctcggcgtgcgcggcgacgcggcgctcaagcgcgccttgctcgaggacgcgcgcgcgcagggccggacggcgaccatcgccgagatcggcgcccacgtggcgcgcatctccgcgagccgcgaggtgctggagacgctcgcggcgatcaaggccgcgggcggcgaggcgcgctacctcgccgtcgacgtcaccgacgccgatcgcctccgcctcgcgctggaagaggtccggcgcgactggggcccgatcaccgccgtcgtccacggcgccggcgtcctcgccgacaagcggatcgaggacaaaacgcccgagcagttcgatcgggtcttcgacaccaaggtcctcgggctgcgcgcgctgctcgccgcgaccgagggcgatccgctgcgcgcgatcatcctcttctcctcggtcgccgcgcgcgcgggcaacgtcggccagtgcgactacgccatggccaacgagatcctcaacaaggtggccatcgccgagcggcggcggcgcggcggcgcgtgcaccgtcaagtccctcggctggggcccctgggagggcgggatggtgacgcccgcgctcaagggtcacttcgaatcgatgggcgtggcgctgatcccgctggccgagggcgccgagcacttcatcgccgagatcgagggctccgccgacgagatcgagctggtgatcggcggcggcgccgacggcagcgccatccgcggggacgccgagccgacgatccacttcggggtctcggtctcggatcgcacgagcccgtggctcgccgatcaccgcgtcgctggtcgccgcgtcatccctgtcgccgtcgtgatcgagtggttcacccgcgcggtcacggcgctccagggccgcgccgcggtgagcctccgcgacgtcaaggtgctgcgcgggatcaagctccccgccggcgacgccgcggcctcgttctcgatcggctgccgcaagctcgccgagggcaagatcgagctcacgctccacggggccgacggcgccctgcactaccgcgcgagcgccgagccccggggcgcggcgctgaagcccgagggcgccgcgcctccgctcgcggcgtggggcgatcggccgatctacgacggcgggctgctcttccacgggccgcgcttccacgcgatccacagcatcgagggcgcctcggccgaagggatccgcgccacgctcaccggcgcgcgcgagctcggctggccgggcgaagcgcagcgcaccgatccggcgatcgtcgacggcgcgctccagctcgcgctgctctggacgcgcgagcgcctcggtcaggcctcgctcccgatggccatcgcggccttcgactggcaggcctcggggccggtcgaaggtccagtgcgcgcggtcgttcaagggcgcgaggccgacagcgctcatgcggtctgcgacgtgtggctcgaggacgcgcgcggcgcgatcgtcggcgcgctccgcggcgtcgagaccatcgtgcggcccgccgaggtccgcgcgccgcacctcgtggagacagggccggcctcgtga

SEQ ID NO: 70 - protein, 2222 aa, Aetherobacter fasciculatus; identical to SEQ ID NO: 65
  SOURCE 1..2222: /mol_type="protein" /note="This sequence is generated from feature [CDS]: 1..6669 placed under sequence number 69" /organism="Aetherobacter fasciculatus"

SEQ ID NO: 71 - DNA, 7911 bp, Aetherobacter fasciculatus
  source 1..7911: /mol_type="DNA" /organism="Aetherobacter fasciculatus"
  CDS 1..7911: /codon_start=1 /product="pfa3"
gtgaccttcgaaccgatcgcgatcgtcgggcaggcctgcacgctccccggcgcgctgacgccggaggcgctgtgggccaacgttctccgcggcgagagcgccgtgacctcgccgccggagggccgctggcgcctcccggcgtggcacgcgatggggaagccgggcgcgcaggaagagcgcgcctggtccgacgccggaggctatgtccgcggcttcgaatcggccttcgatcccggcggcctgcgcctcccggaggccgagctccgcggcctcgatccggtgttccagtggacgctccacaccgcgcgcgcggccctgcgctccgcggggatggaggggccgtcggcgcgcgccgggctcgtcctcggcaacctctcgttcccgacggcgtcgatgtcgcgctacgccgagagcgtctggctcgaggcgctgggcaaggagctcctcggcgggcgcgccgcggcgcaggccggcgtcacccaccccgacgcgcacaaccgcttcatgtccgggctccccgcgcacctcgccgcgcaggccctcgggctcggcgggggcgccttcgcgctcgacgccgcctgcgcctcgtcgctctacgcgatcaagctcgcctgcgaccggctccaggatcgcgctactgatctgatgctggccggcgccgtcaacgccgccgacagcctcttcctccacatcgggttctcggccctctcggcgatgagccgcaccggccagtcgcgcccgtttcaccgcgaggccgacggcctcgtcccctcggagggggccgtcttcttcgcgctccagcgcctcgacgacgcgcgcgccgccggccgccgcgtcctcgggatcatccgcggcgtcggcctctccaacgacgggcgcggccgcggcctcctcgcgccctcggaggagggacagatccgcgccatgcgcctggcctacgccgcggcggggctcacgccctccgacgtgagcttcgtcgagtgccacgccaccggcacgcccgtcggtgacgccaccgagatccggagcctcagcgaggtcttcgccgggtgccgcgacgtgcccatcggctcgctcaagtccaacctcggccacctcatcaccgccgcgggcggcgccggcttgatcaaggtcctcggatcgttcaccgccgaaacgatcgcgccgacgatccacgccggcgcttcgatccccgagctcgccgggtcgccggtccgcctcgtcacgcaggccgagccctggcgcgcggcgggccgccgcatcgccgcgatcagcgccttcgggttcggcggcaacaacgcccacctgatcgtcgagcaggacgacggccgcgccacggcgccgcgggccgcagcgccgcgatccgcgccggcgccgatcgccgtcatcagcctcggcgccaggatcggcgacaccaccggccgcgacgaggccgcgcgcgcgctgctctccggcgcgggctggggcagccgccgcgaggcggtcacggtcgagctcgaggggctgcgcttcccgccgcgcgatctcgagcagacgctcccgcagcagctcctcgtgctcgaagcggggcgcgaggcgatccgcgggctctcgctcccgcgcgatcgcaccgccgtgctcatcggcatgggcgccgatcccgaggtcgcgcgctacggcgctcgctggcgcctgcccgcgttcgccgacgcctgggcggccgccgggctccccgtgtccagcgcctggaccgaggccgcgcgcgacgccgtgcaagagcagcacggcgcggccggcgtcgtcggcgccatgcccaacatcccggccaaccgcctcagcagccagctcgatctcgccgggccgagcttcaccatctcctcggaggagctctccggcgtcgtcgccctgcagctcgccgcgcgcgcgctgcgcagcggcgagatcgacgcggccctcgtcggcgccgtcgatctcgccgatcagatcgtccaccgcaaggcgctgggcgagctcggcctcgagccccgcgccggcgacgccgcggtcgcgctcgtgctcaagcgcctcaccgacgtgcgcaagagcgagaaggtcctggcgatcctcgacgagggcatcgtggacgcgtccagcgatcccgcgcgcctccgcgtcggcgacggcggcgccgatctcgatcccttcgccaccacgggcaagccgcacgcggcggcgggcctcgtccacgtcgccgccgccgtgctcgcgctgcaccacggcgcgcgccccgcccccgggcgcgcctccatgccctgggtcggcccccgccacgccgaggtgacgacgcaggccctcggcgatcaggcggcgacgatccacctccgcggcggcggcctcgccgcgccgctgctgctcgacgccacgccgcagatccatgtcttcgccggcgccgatcgcgaggccgtgctccgcgccctcagcgacgggcgcgagggcctcgacggcccggcgcgcgcggtgatcgtggccggctcgcgcgaggagctcgaggcgcgccgcgccgacgccctccgcgccgccgagcgcaacgcccccatgcccgacggcgtcttcctccgcgatcgccccgtcgcgggcgagctcgccttcgtcttcgcaggcgccgccgcggcgtacccgagcatgggccgcgccctcgcgctcgcgctccccgacgtgatggcgcgcctcggcaaccggctctcgacgctgcccgcggtgatcgactggatccacggcgcgccccgcgagccgcgccacccgctcgagcagctctgggcgtcgtcgttcctctgccagctccacgccgagatcacccgcgtcgacctcgggctccgccccagcgcgaccatcggctactcctccggcgagagcaatgcgctcttcgccatgggcgcctggcgcgacctcgacgccatgatgcacgaggcctggaccgagccgctgctgaccacggagctcgtcggcgactacgccgcggcgcgccgcctctgggcgcgctccggcgtcaccagccccgcggcgacgtgggccgcgtgggtcatcgccgcgcccgtggacgacgtgcgccgcgccctcacgggcgagccgctcgcgcacctcaccatcatcaacaccgccgaggagtgcgtgatcggcggcgaggcctccgcgtgcgaacgcgtcgtcgcgcggctcggcaagaacctcgcgctgccgctcagctacgccatggcctcgcactgccccgaggtcgccgaggcgcgcgaggcgtggatcaagatgcaccgccgcgccaccttcgacgtccccggcgtgcgcatctactccgccggcgccgagcaggccttcgcccccaccgccgacgccgccgcgatggccatcaccggccaggccgtcgacacgctcgatttcccccgcgtgatcgagcgcgcctacgccgacggcgtccgcgtcttcgtcgagcacggcccgcgcggcctctgcagccgctggatcgcgcgcatcctcggcgcgcgcgagcacctcgtcgtcccgctcgacgtcgccgggcagcagccggtccgccagctcgtgagcgccgtggcccagctcatcgccgccggcgtgcccgtcgccgccgacgccctcctcgccaggctcgcgccgcctcccccggcgcgcgcctcgggccccacgctcaccgtgcgcgctcaccctcctgacattcacttcccgacggcccctgccatgcaactgatgccgcccgcgccccttctcccgccggtgctcgccgacaaccccgcgccgcgcacggagcggagcttcaccgggcggtcggcgctgcgagaggacgcgcccgacggcgtcccctcgcctcgcctccccgtgttcgcgaggctcgcgccggtgttcacccacaccgagccggtgttcacgcacgtcgagccggcgctcgcgagccctgagccggcggtcacgcaccccgagccggtgatcgcgcacgccgagccggcgctcacacacgccgagcccgcgctcgcgagccccgcggatggccagcacgcctccatcgccgcgcgcggcgccgccgtgagcgcggggatcgccgccgcccatcgcgcctacgtcgaggcgcaaggcgccgtgcacgcccgcttcctcgcgctctcgggctccttgctctcgcgcctcgccgccgccccgacagccgccgccttcccggcgcctgctccctcgctcgcgccgcagcccgccgccctcccggcgcccgctccgcaggccgccccgccgcagcgcctcaccgcccccaccctcgtggtcgctcggccggtcgcgccgcccgccccgacgccggtgcccgccgccgtggccgcgttcgctcccgcgccgatctcggctccggcctccaccctgcccgcgccgtccctgctccgctccacgctccccgggcccaagttctcgcgcgcggatctcgaggtcctggcctcgggctcgatctcctcgatcttcggcccccagttcgccggccaggatggctatgccaaacaatgtcggatgccggagcccccgctcctgctcgccgatcgcgtcactggcatcgacgctgtccccggctcgatggacacgggcaccatctggaccgagaccgacgtcaagcacgacagctggtatctccaccagggccggatgccgactggcatcgtgatcgagtccggccaggcggatctcctcctgatctcctggctcggtatcgacgccctcaacaagggggagcgcgtctatcgcctcctcggctgcgaggccacctatcacggcgagctgccaaagccgggcgacacgctcgtctacgagatccacatcgacggccacgccgagcagggcgacgtgcggctgttcttcttccactacgactgccgcatcaacggcgagctgcggatctcggtgcgcaacggccaggccgggttcttcacctatcaagagctcgccaactccggcggagtgctctgggacgccgacggcgcgccccacgaggcgacaggccccctcgatccgcctcaagtgatctgcgagaagcagtccttcacctcggccgaggtcctcgccttctccgagggggacgcctacgcctgcttcgggcgcggcttcgagcgcgcgcagacgcacgtgcgcacgccgcgcatccaggacgggccgatgcggctcctcgatcgcgtcacccacttcgatcctcgcggcgggccctgggggcgcggctacctgcgcgccgaggccaagctctcgcccgacgactggttcttgcgagggcacttcaagaacgatccctgcatgccagggacgctgatcctcgaggcctgcgtgcaggccatggccttctatctctgcgccatgggctactccatcgatcgcgacggctggcgcttcgagcctgtccccggccagaagagcccgatgcgctgccgcggccaggccagcgtgacctcgcgggagatcgtctacgagatcttcgtccacgaggtcacgagcgggcctatccccagcgtcaaggtcgacatgctctgcaccgtcgacggcctcaaggccttccacggcgagcgcgtcggcctgcgcctcgtccccgcctggcccctcgacgactggcgacaggcccccgtcgccccgcagagcctgcaccgccgccccaagcagatcgcccctctcggcgggatcctcggccacgtcgagacccggccggtgccctcggtcaacggctttgccttcgactacgcctcgctcatcgcctgcgcctggggcaagccctcgcaggccttcgggccgatgtacgcgcccttcgacggcactcgccgcgtcgcccgcctgcccgggccgccttatcacttcatcacgcgcatcatctcggtcgagggcccgatcggcgtcccccagcccggcgccgaggtcgaggtcgagtacgacgtcccccacgacgcctggtatttcgcggagaacggcgcgcgcaccatgccgttctgcgtcctgctcgaggccgcgctccagccctgcggctggctggcgagctacatcggcagcgccctcaccaccgaggacgatctgctcttccgcaacctcgacgggactggcaccgtcctcgcggagatcacccccgagtccggcacgctgcgcacccacgtcaaggtggtcgaggtctcgcagtccgcggggatgatcatcgagaccttcgaagtcgagtgcttcgtcggcgaagcccacgtgtacacgctgcgcaccgtctttggcttcttccccaaatcggccttcgacaaccaggtcggactccccgtctccgccgaggcccgcgcccggatcgagcgtcaagccacctcgaccatcgatctggctccggagccgccgcgctacttcgccggcgcccctcgcctccccgaagcgatgctgtgcatgctcgatcgcatcaccgcgttcgagccgaccggcggcctcaagggccttggctatggccgcgccgagaagacggtcaaacccggggagtggtccttcaaagcccacttcttccaggatcccgtccagccgggctccctcggcctcgaggccctgctccagctccttcaggcgtggatgatcgacgccggtgacgccgagggtatcccgggcgcgcgcttcgaacccatcgccgtcggccgcccgatgacctggaaataccgcggccaggtcgtccccaagaacctcctcgtgacggtggagatcgacatcaccgagcgcggcaccgacgatcgcgggcgcttcgccctggccgagggctcgctctgggtcgacggcaagcgcatctacggcgcgaagaacctcggcatgcgcgtcgtcgccggccccgagcgcccgccgcccggctcgccgccttcgcccgcttcgccgaccgcgccgaccgcgcccccttcgccgcctgccccgacggtgccggctgcgctggctgcgccgccttcgcgcgatctcgcctcgtttcgaagcttctggcgcgcctcgatcggggtcgggccctggccgatcgaggacctctacatcgccctggtcgagcgcttcctcggccggatcgtcatcgccgatccggtcgccttctcgcgcgtccacggccgcggctgcctctacgtcgccaaccaccaggtcgcgctggagtcgctgatcttcatcatggtcgcctcggcgatctccggcacgcggacgatggcgctcgccaaggccgaacatcaggagtcgtggctcgggcgcctgatcacccgcggcatcgcctaccccggcgtcaccgatccaggcctcatcaccttcttcgaccgcgaggatcacgcctccttcgcccgcatcgccgagcaggccacgcgcgatctcgcggcctcgaccaagagcgtgctcgtccacgtcgagggcacgcgcgccatctcgtgccgcacccccgtcacccgcctcggcgcctcggtgatcgacatggcgctggccgccggcgcgcccatcgtcccggtccgcttcgcgcgcggcctgcccgagagcgactcccccgagcgcctcgatttcccgctcggctacggccgccaggacatctacttcggcgccccgatcgagcccgccgagctcgcgcgcctcccgctcaaggaccgcaaggacgccttgctcacggccctcaacacgctcggccccggcgcgagcgacacgccctccgaccccgacccgagcttcgccgcccaggtcgaggcctggcgagcccgcaccggctgcgccatcgaagatgccgtgttctatgccaccctcgccggagcgtcagccccggagtcggagggcgtgcagcggttactggagggcgcgagaacggggaagctggttatcgggagtggggagaaggatcgctggctgggggagtttgcgcggagcctgtttggatcggcggatgcgacgctcttggtggagggcggctga

SEQ ID NO: 72 - protein, 2636 aa, Aetherobacter fasciculatus; identical to SEQ ID NO: 66
  SOURCE 1..2636: /mol_type="protein" /note="This sequence is generated from feature [CDS]: 1..7911 placed under sequence number 71" /organism="Aetherobacter fasciculatus"

SEQ ID NO: 73 - DNA, 1608 bp, Aetherobacter fasciculatus; identical to SEQ ID NO: 67
  source 1..1608: /mol_type="DNA" /organism="Aetherobacter fasciculatus"
  CDS 1..1608: /codon_start=1 /product="domain I" /transl_table=1

SEQ ID NO: 74 - protein, 535 aa, Aetherobacter fasciculatus; identical to SEQ ID NO: 64
  SOURCE 1..535: /mol_type="protein" /note="This sequence is generated from feature [CDS]: 1..1608 placed under sequence number 73" /organism="Aetherobacter fasciculatus"

SEQ ID NO: 75 - protein, 535 aa, Aetherobacter fasciculatus; identical to SEQ ID NO: 64
  SOURCE 1..535: /mol_type="protein" /organism="Aetherobacter fasciculatus"

SEQ ID NO: 76 - DNA, 3492 bp, Aetherobacter fasciculatus
  source 1..3492: /mol_type="DNA" /organism="Aetherobacter fasciculatus"
  CDS 1..3492: /codon_start=1 /gene="domain IIa" /transl_table=11
atgactcaggttccggtcgccatcgtcggcgtgggcgcgctctttccgggctcgcccgacggtgcaggcttctggcgcgacatcgtcgcgtcacgcgatctcgtctccgacgtccccccggggcactggctgatcgaggactactacgatcccgatccctcggcgccggacaagacctactccaagcgcggggccttcctcggcgagacggccttcgatccgctggagttcggcgtggtgccgagctcgctcccgaccaccgacaccgcgcagctgctggcgctgatcgtggcgcggcgggtgctcgacgacgcgacccaggggcgcttcgcttccatcgatcgatcgcgcatcggcgtcgtcctcggcgtgacctcggggcaagagctcctcggcacgatggtgagccggctccagcggccggtgtggctcaaggcgctgcgcgacgacggcgtgcccgaggccgacgcgcagcggatctgcgatcggatcaccaacgagtacgtgccctggaaggagtcgacgttccccgggctcctcggcaacgtggtcgccgggcgcatcgccaaccgcttcgatctcggcggcaccaactgcgtcaccgacgcggcgtgcgcgagctcgctcgcggcgctctcgatcgccatgaacgagctggcgctcgggcagtcggatctcgtgatcaccggcggggtggacacgatgaacgacatcctgatgtacacctgcttcagcaagaccccggcgctctcgaagtcgggcgactgccgccccttctccgacgccgccgacgggacgctgctcggcgagggcctggcgatgttcgcgctcaagcgcctcaccgacgccgagcgcgacggggatcgcgtctacgcggtgatccgcggcctgggatcgtcgtcggacgggcggagcaagagcgtgtacgcgccggtgccggaagggcaggccaaggcgctggtgcgggcctacgaggcggccggctacggcgcggacacggtggagctggtcgaggcgcacggcaccgcgaccaaggccggcgacgcggcggagttcggcggcctcaagctggcgttcgaggcgagcgggcgcgcggatcaccagtggtgcgcgctcggatcggtgaaatcgcagatcgggcacaccaagtcggcggccggcgcggcgggcctcttcaaggcggtgatggcgctgcaccacaaggtcctgccgccgacgatcaaggtcgatcgccccaaccccgagctggcgatcgaggcgagcccgttctacctcaacacgcaggcgcggccctgggtgcgcaacgcgcagcacctgcggcgggcctcggtctcgagcttcggcttcggcgggagcaacttccacgtgacgctggaggagtacgccggcacggcggagccggcggcgcgcctgcgcacggcgccgacggagctcttcgtgatctcggcgccctcggcggcggaggtcctcgcgcgcgccggcaagctcgccgagctcgcggacaaagagggcacgacgacggcggcgcggacctcgcagcgcgacttcgtgacggcggatcacgcgcggctctccatcgtggcgagcgacgccgcggatctgcgcgccaagctcgagcaagcgcgctcgctcctgtcggcgcgccccgaggaggcgttctcgacgccgaccggcgtccacttcgcggtgggcgcggcggcgggcggcgtggcgttcctcttccccgggcaggggagccagtacgtgggcatgggcgccgacgtggccatggagcacggcgtcgcgctcgacgcgtgggacgcggcggcgggcctggtcgagaccgcggggctgcgcgacgtggtcttcccgcgcccggccttcaccgacgaggcgcgagccgagcaggcgcagctcttgacggcgaccgagtgggcgcagccggcgatcgccacggcgagcctcgcgctcctcgcggtgctgcgggcggtcggcgtccgcccgtcgagcgtcgccggtcacagcctgggcgagctcaccgcgctcgccgcggccgatgctttgagcaccaacgatctcgtggccacggcgcgcaagcgcggccagctcatgaacgcggcgtcgagcacgccgggggcgatgaccgcggtggcgcggcccctcgccgaggtgcaggccctcctcgagcgcctccagagcgaggtggtggtggccaaccacaaccacccgacccaggtcgtcctcgccggcgagaccgccgcgatcgaggcggtcgaggccgagctcgcgcgccaggggatcaccgccaagcggctcccggtcgccacggcgttccacagccaggtcgtggccggggcgacggcgcccttcgccgagcacctcgccgggatcgcggtgaaggcgccggccatcgacgtgctctccaacagcgaggccgcggcctacccgtcggatcccgacgcggtgcgcgcgctcctcgccgggcagatcacgcgctcggtccgcttcgtcgaggtggtcgaggcgatgtgggcgcgcggggcgcgcatcttcgtggaggtcggcccctcggcggtgctgaccgagctctgcgcgcggatcctcggcgagcggccgcacctggcgatcgccatggatcgcaagggcaagcacggcgtgaccgcgctccaggacgcgctcgggcgcctcgccgcggccggcgtggccatcgacttcgccccgctgtgggcgccgttcggcccgcccgcggcgccgaagcgggtgccggcgatgtcgatgatgatcaacggcgcgaactacgggaaggtctacccgcccaagggcggcgccgcggcgctgccgccgccgaacccgccgcgcccggtcgttgctgctgcaacgatcgccgcggcgccgagctcggcggccaaggctccggtcgttgctgctgcaacgatcgcggcggcgccgatcccggcggccaaggctccggtcgttgctgctgcaacgatcgcggcgcgccccgcggcggcgcccgagtcgcggccggtcgtcgcggctgccccggcccctgcgccggttgtggcggcgcccgcgtcggcggcggcggcgctgtcggcgccgggtcagctcggctggatcgaggcgtaccaggagtcgcagcggcagctcaccgaggcgcacgcgtcgtacgtgcggacgatggcgtcggggcacgaggcgttcctcacgacgatggaggcctcgttcatcgggctcggcggcctgctcggcgcgccggcttcggtgtccgcggtcgccccgcggagcgcagcggctccggtgctcgcgcagccggtcgcggtcgctccggctccggtgctcgcgccggctccggtgcccgcgcccgctccgactccggtgctcgctccggctcccgctccggtgctcgcgcctgcgcctgtcgccgcggtggcgaaggcggctcccgcgccggtgatggcgcccgcggcgccgtcaatcgatctccaggcgctgctgctcgacgtggtcgcg

SEQ ID NO: 77 - protein, 1164 aa, Aetherobacter fasciculatus
  SOURCE 1..1164: /mol_type="protein" /note="This sequence is generated from feature [CDS]: 1..3492 placed under sequence number 76" /organism="Aetherobacter fasciculatus"
MTQVPVAIVGVGALFPGSPDGAGFWRDIVASRDLVSDVPPGHWLIEDYYDPDPSAPDKTYSKRGAFLGETAFDPLEFGVVPSSLPTTDTAQLLALIVARRVLDDATQGRFASIDRSRIGVVLGVTSGQELLGTMVSRLQRPVWLKALRDDGVPEADAQRICDRITNEYVPWKESTFPGLLGNVVAGRIANRFDLGGTNCVTDAACASSLAALSIAMNELALGQSDLVITGGVDTMNDILMYTCFSKTPALSKSGDCRPFSDAADGTLLGEGLAMFALKRLTDAERDGDRVYAVIRGLGSSSDGRSKSVYAPVPEGQAKALVRAYEAAGYGADTVELVEAHGTATKAGDAAEFGGLKLAFEASGRADHQWCALGSVKSQIGHTKSAAGAAGLFKAVMALHHKVLPPTIKVDRPNPELAIEASPFYLNTQARPWVRNAQHLRRASVSSFGFGGSNFHVTLEEYAGTAEPAARLRTAPTELFVISAPSAAEVLARAGKLAELADKEGTTTAARTSQRDFVTADHARLSIVASDAADLRAKLEQARSLLSARPEEAFSTPTGVHFAVGAAAGGVAFLFPGQGSQYVGMGADVAMEHGVALDAWDAAAGLVETAGLRDVVFPRPAFTDEARAEQAQLLTATEWAQPAIATASLALLAVLRAVGVRPSSVAGHSLGELTALAAADALSTNDLVATARKRGQLMNAASSTPGAMTAVARPLAEVQALLERLQSEVVVANHNHPTQVVLAGETAAIEAVEAELARQGITAKRLPVATAFHSQVVAGATAPFAEHLAGIAVKAPAIDVLSNSEAAAYPSDPDAVRALLAGQITRSVRFVEVVEAMWARGARIFVEVGPSAVLTELCARILGERPHLAIAMDRKGKHGVTALQDALGRLAAAGVAIDFAPLWAPFGPPAAPKRVPAMSMMINGANYGKVYPPKGGAAALPPPNPPRPVVAAATIAAAPSSAAKAPVVAAATIAAAPIPAAKAPVVAAATIAARPAAAPESRPVVAAAPAPAPVVAAPASAAAALSAPGQLGWIEAYQESQRQLTEAHASYVRTMASGHEAFLTTMEASFIGLGGLLGAPASVSAVAPRSAAAPVLAQPVAVAPAPVLAPAPVPAPAPTPVLAPAPAPVLAPAPVAAVAKAAPAPVMAPAAPSIDLQALLLDVVA

SEQ ID NO: 78 - protein, 1164 aa, Aetherobacter fasciculatus; identical to SEQ ID NO: 77
  SOURCE 1..1164: /mol_type="protein" /organism="Aetherobacter fasciculatus"

SEQ ID NO: 79 - DNA, 798 bp, Aetherobacter fasciculatus
  source 1..798: /mol_type="DNA" /organism="Aetherobacter fasciculatus"
  CDS 1..798: /codon_start=1 /gene="domain IIb" /transl_table=11
gacaagaccggctaccccgccgagatgctcggcatgcacatggagctcgaggccgatctcggcatcgactccatcaagcgcgtcgagatcctctccgccatgcgcaagcgcgcgcccaacctcccggaggtcgtcgcctccgagatggccacgctccgcaccctcgggcagatcgtcgagtacatgcgcgagcggtccggtgcgctgacggctgcgactcacgagacgctggttcccgcgacggcagaggctgcgacccaggcggctccggcgctcggcgatctccaggcgctgctgctcgacgtggtcgcggacaagaccggctaccccgccgagatgctcggcatgcacatggagctcgaggccgatctcggcatcgactccatcaagcgcgtcgagatcctctccgccatgcgcaagcgcgcgcccaacctcccggaggtcgtcgcctccgagatggccacgctccgcacgctcgggcagatcgtcgagtacatgcgcgaccgctccggcgcgacggcggctccggtgaaggcagcgcctgcgcctgcgcctgcgcctgcggcggctccgacgaaggaagcgccgacgctggcggatctgcaaacgctgctgctcagcgtcgtcgcggacaagaccggctaccccgccgagatgctcggcatgcacatggagctcgaggccgatctcggcatcgactccatcaagcgcgtcgagatcctctccgccatgcgcaagcgcgcgcccaacctcccggaggtcgtcgcctccgagatggccacgctccgtacgctcggg

SEQ ID NO: 80 - protein, 266 aa, Aetherobacter fasciculatus
  SOURCE 1..266: /mol_type="protein" /note="This sequence is generated from feature [CDS]: 1..798 placed under sequence number 79" /organism="Aetherobacter fasciculatus"
DKTGYPAEMLGMHMELEADLGIDSIKRVEILSAMRKRAPNLPEVVASEMATLRTLGQIVEYMRERSGALTAATHETLVPATAEAATQAAPALGDLQALLLDVVADKTGYPAEMLGMHMELEADLGIDSIKRVEILSAMRKRAPNLPEVVASEMATLRTLGQIVEYMRDRSGATAAPVKAAPAPAPAPAAAPTKEAPTLADLQTLLLSVVADKTGYPAEMLGMHMELEADLGIDSIKRVEILSAMRKRAPNLPEVVASEMATLRTLG

SEQ ID NO: 81 - protein, 266 aa, Aetherobacter fasciculatus; identical to SEQ ID NO: 80
  SOURCE 1..266: /mol_type="protein" /organism="Aetherobacter fasciculatus"

SEQ ID NO: 82 - DNA, 2379 bp, Aetherobacter fasciculatus
  source 1..2379: /mol_type="DNA" /organism="Aetherobacter fasciculatus"
  CDS 1..2379: /codon_start=1 /gene="domain IIc" /transl_table=11
cagatcgtcgagtacatgcgcgaccgctccggcgggcacagcgtggcggccacgacaccggcaccggctccggcctcgactctcgctccggcggcgagccggatcggtcgctacgtggtgggcacgcgcgaggaggcggcgagcgggctggcgatgggcggcgtgctcggcgcgcggcgcttcgtcatcaccaacgaagggacgggcatcgcgcaggcgctggtgcgggcgctgcaagagcgcggcgtcagcagcgaggtcgtgaccgaggtgccggcggacgccgacgcggtggtgttcctcggcgggctccggaccctcgtcgacgtcgacacggccatcgcgatcaaccgcgaggcgttcctcgcggcgcgcgctgtggccagtgtgttctcgcgcgacggcggcgccttcgtgacggtccaggacacgggcggcgatctcgggatcgaggcgcgcgagccgcgggcagcgtggctcgcgggcgtggccgcgctggcgcggacggcgcagctcgagtggccgaaggcctcggtgaaggccgtcgacgtcgagcgcggcgggcgcagctccgaggagatcgccgcggcgatcgccgaggagatcctcaccggcggcggcgcgctcgaggtcggcctgacggcggccggcgcgcggcgcgtccccgaggtcgtgcagcgcgcggtgggcgagcggaccccggtcctcgctcgcagctcggtcgtcgtcgcctccggcggggcccgcggcgtcaccgccacggcgctgatcgcgctggcgcgccacgcgcagccgaagctggtgatcctcgggcgatccgcgctcgaggcggagccggcggcctgcctcggcgtgcgcggcgacgcggcgctcaagcgcgccttgctcgaggacgcgcgcgcgcagggccggacggcgaccatcgccgagatcggcgcccacgtggcgcgcatctccgcgagccgcgaggtgctggagacgctcgcggcgatcaaggccgcgggcggcgaggcgcgctacctcgccgtcgacgtcaccgacgccgatcgcctccgcctcgcgctggaagaggtccggcgcgactggggcccgatcaccgccgtcgtccacggcgccggcgtcctcgccgacaagcggatcgaggacaaaacgcccgagcagttcgatcgggtcttcgacaccaaggtcctcgggctgcgcgcgctgctcgccgcgaccgagggcgatccgctgcgcgcgatcatcctcttctcctcggtcgccgcgcgcgcgggcaacgtcggccagtgcgactacgccatggccaacgagatcctcaacaaggtggccatcgccgagcggcggcggcgcggcggcgcgtgcaccgtcaagtccctcggctggggcccctgggagggcgggatggtgacgcccgcgctcaagggtcacttcgaatcgatgggcgtggcgctgatcccgctggccgagggcgccgagcacttcatcgccgagatcgagggctccgccgacgagatcgagctggtgatcggcggcggcgccgacggcagcgccatccgcggggacgccgagccgacgatccacttcggggtctcggtctcggatcgcacgagcccgtggctcgccgatcaccgcgtcgctggtcgccgcgtcatccctgtcgccgtcgtgatcgagtggttcacccgcgcggtcacggcgctccagggccgcgccgcggtgagcctccgcgacgtcaaggtgctgcgcgggatcaagctccccgccggcgacgccgcggcctcgttctcgatcggctgccgcaagctcgccgagggcaagatcgagctcacgctccacggggccgacggcgccctgcactaccgcgcgagcgccgagccccggggcgcggcgctgaagcccgagggcgccgcgcctccgctcgcggcgtggggcgatcggccgatctacgacggcgggctgctcttccacgggccgcgcttccacgcgatccacagcatcgagggcgcctcggccgaagggatccgcgccacgctcaccggcgcgcgcgagctcggctggccgggcgaagcgcagcgcaccgatccggcgatcgtcgacggcgcgctccagctcgcgctgctctggacgcgcgagcgcctcggtcaggcctcgctcccgatggccatcgcggccttcgactggcaggcctcggggccggtcgaaggtccagtgcgcgcggtcgttcaagggcgcgaggccgacagcgctcatgcggtctgcgacgtgtggctcgaggacgcgcgcggcgcgatcgtcggcgcgctccgcggcgtcgagaccatcgtgcggcccgccgaggtccgcgcgccgcacctcgtggagacagggccggcctcgtga

SEQ ID NO: 83 - protein, 792 aa, Aetherobacter fasciculatus
  SOURCE 1..792: /mol_type="protein" /note="This sequence is generated from feature [CDS]: 1..2379 placed under sequence number 82" /organism="Aetherobacter fasciculatus"
QIVEYMRDRSGGHSVAATTPAPAPASTLAPAASRIGRYVVGTREEAASGLAMGGVLGARRFVITNEGTGIAQALVRALQERGVSSEVVTEVPADADAVVFLGGLRTLVDVDTAIAINREAFLAARAVASVFSRDGGAFVTVQDTGGDLGIEAREPRAAWLAGVAALARTAQLEWPKASVKAVDVERGGRSSEEIAAAIAEEILTGGGALEVGLTAAGARRVPEVVQRAVGERTPVLARSSVVVASGGARGVTATALIALARHAQPKLVILGRSALEAEPAACLGVRGDAALKRALLEDARAQGRTATIAEIGAHVARISASREVLETLAAIKAAGGEARYLAVDVTDADRLRLALEEVRRDWGPITAVVHGAGVLADKRIEDKTPEQFDRVFDTKVLGLRALLAATEGDPLRAIILFSSVAARAGNVGQCDYAMANEILNKVAIAERRRRGGACTVKSLGWGPWEGGMVTPALKGHFESMGVALIPLAEGAEHFIAEIEGSADEIELVIGGGADGSAIRGDAEPTIHFGVSVSDRTSPWLADHRVAGRRVIPVAVVIEWFTRAVTALQGRAAVSLRDVKVLRGIKLPAGDAAASFSIGCRKLAEGKIELTLHGADGALHYRASAEPRGAALKPEGAAPPLAAWGDRPIYDGGLLFHGPRFHAIHSIEGASAEGIRATLTGARELGWPGEAQRTDPAIVDGALQLALLWTRERLGQASLPMAIAAFDWQASGPVEGPVRAVVQGREADSAHAVCDVWLEDARGAIVGALRGVETIVRPAEVRAPHLVETGPAS

SEQ ID NO: 84 - protein, 792 aa, Aetherobacter fasciculatus; identical to SEQ ID NO: 83
  DOMAIN 1..792: "domain IIc"
  SOURCE 1..792: /mol_type="protein" /organism="Aetherobacter fasciculatus"

SEQ ID NO: 85 - DNA, 2607 bp, Aetherobacter fasciculatus
  source 1..2607: /mol_type="DNA" /organism="Aetherobacter fasciculatus"
  CDS 1..2607: /codon_start=1 /gene="domain IIIa" /transl_table=11
gtgaccttcgaaccgatcgcgatcgtcgggcaggcctgcacgctccccggcgcgctgacgccggaggcgctgtgggccaacgttctccgcggcgagagcgccgtgacctcgccgccggagggccgctggcgcctcccggcgtggcacgcgatggggaagccgggcgcgcaggaagagcgcgcctggtccgacgccggaggctatgtccgcggcttcgaatcggccttcgatcccggcggcctgcgcctcccggaggccgagctccgcggcctcgatccggtgttccagtggacgctccacaccgcgcgcgcggccctgcgctccgcggggatggaggggccgtcggcgcgcgccgggctcgtcctcggcaacctctcgttcccgacggcgtcgatgtcgcgctacgccgagagcgtctggctcgaggcgctgggcaaggagctcctcggcgggcgcgccgcggcgcaggccggcgtcacccaccccgacgcgcacaaccgcttcatgtccgggctccccgcgcacctcgccgcgcaggccctcgggctcggcgggggcgccttcgcgctcgacgccgcctgcgcctcgtcgctctacgcgatcaagctcgcctgcgaccggctccaggatcgcgctactgatctgatgctggccggcgccgtcaacgccgccgacagcctcttcctccacatcgggttctcggccctctcggcgatgagccgcaccggccagtcgcgcccgtttcaccgcgaggccgacggcctcgtcccctcggagggggccgtcttcttcgcgctccagcgcctcgacgacgcgcgcgccgccggccgccgcgtcctcgggatcatccgcggcgtcggcctctccaacgacgggcgcggccgcggcctcctcgcgccctcggaggagggacagatccgcgccatgcgcctggcctacgccgcggcggggctcacgccctccgacgtgagcttcgtcgagtgccacgccaccggcacgcccgtcggtgacgccaccgagatccggagcctcagcgaggtcttcgccgggtgccgcgacgtgcccatcggctcgctcaagtccaacctcggccacctcatcaccgccgcgggcggcgccggcttgatcaaggtcctcggatcgttcaccgccgaaacgatcgcgccgacgatccacgccggcgcttcgatccccgagctcgccgggtcgccggtccgcctcgtcacgcaggccgagccctggcgcgcggcgggccgccgcatcgccgcgatcagcgccttcgggttcggcggcaacaacgcccacctgatcgtcgagcaggacgacggccgcgccacggcgccgcgggccgcagcgccgcgatccgcgccggcgccgatcgccgtcatcagcctcggcgccaggatcggcgacaccaccggccgcgacgaggccgcgcgcgcgctgctctccggcgcgggctggggcagccgccgcgaggcggtcacggtcgagctcgaggggctgcgcttcccgccgcgcgatctcgagcagacgctcccgcagcagctcctcgtgctcgaagcggggcgcgaggcgatccgcgggctctcgctcccgcgcgatcgcaccgccgtgctcatcggcatgggcgccgatcccgaggtcgcgcgctacggcgctcgctggcgcctgcccgcgttcgccgacgcctgggcggccgccgggctccccgtgtccagcgcctggaccgaggccgcgcgcgacgccgtgcaagagcagcacggcgcggccggcgtcgtcggcgccatgcccaacatcccggccaaccgcctcagcagccagctcgatctcgccgggccgagcttcaccatctcctcggaggagctctccggcgtcgtcgccctgcagctcgccgcgcgcgcgctgcgcagcggcgagatcgacgcggccctcgtcggcgccgtcgatctcgccgatcagatcgtccaccgcaaggcgctgggcgagctcggcctcgagccccgcgccggcgacgccgcggtcgcgctcgtgctcaagcgcctcaccgacgtgcgcaagagcgagaaggtcctggcgatcctcgacgagggcatcgtggacgcgtccagcgatcccgcgcgcctccgcgtcggcgacggcggcgccgatctcgatcccttcgccaccacgggcaagccgcacgcggcggcgggcctcgtccacgtcgccgccgccgtgctcgcgctgcaccacggcgcgcgccccgcccccgggcgcgcctccatgccctgggtcggcccccgccacgccgaggtgacgacgcaggccctcggcgatcaggcggcgacgatccacctccgcggcggcggcctcgccgcgccgctgctgctcgacgccacgccgcagatccatgtcttcgccggcgccgatcgcgaggccgtgctccgcgccctcagcgacgggcgcgagggcctcgacggcccggcgcgcgcggtgatcgtggccggctcgcgcgaggagctcgaggcgcgccgcgccgacgccctccgcgccgccgagcgcaacgcccccatgcccgacggcgtcttcctccgcgatcgccccgtcgcgggcgagctcgccttc

SEQ ID NO: 86 - protein, 869 aa, Aetherobacter fasciculatus
  SOURCE 1..869: /mol_type="protein" /note="This sequence is generated from feature [CDS]: 1..2607 placed under sequence number 85" /organism="Aetherobacter fasciculatus"
VTFEPIAIVGQACTLPGALTPEALWANVLRGESAVTSPPEGRWRLPAWHAMGKPGAQEERAWSDAGGYVRGFESAFDPGGLRLPEAELRGLDPVFQWTLHTARAALRSAGMEGPSARAGLVLGNLSFPTASMSRYAESVWLEALGKELLGGRAAAQAGVTHPDAHNRFMSGLPAHLAAQALGLGGGAFALDAACASSLYAIKLACDRLQDRATDLMLAGAVNAADSLFLHIGFSALSAMSRTGQSRPFHREADGLVPSEGAVFFALQRLDDARAAGRRVLGIIRGVGLSNDGRGRGLLAPSEEGQIRAMRLAYAAAGLTPSDVSFVECHATGTPVGDATEIRSLSEVFAGCRDVPIGSLKSNLGHLITAAGGAGLIKVLGSFTAETIAPTIHAGASIPELAGSPVRLVTQAEPWRAAGRRIAAISAFGFGGNNAHLIVEQDDGRATAPRAAAPRSAPAPIAVISLGARIGDTTGRDEAARALLSGAGWGSRREAVTVELEGLRFPPRDLEQTLPQQLLVLEAGREAIRGLSLPRDRTAVLIGMGADPEVARYGARWRLPAFADAWAAAGLPVSSAWTEAARDAVQEQHGAAGVVGAMPNIPANRLSSQLDLAGPSFTISSEELSGVVALQLAARALRSGEIDAALVGAVDLADQIVHRKALGELGLEPRAGDAAVALVLKRLTDVRKSEKVLAILDEGIVDASSDPARLRVGDGGADLDPFATTGKPHAAAGLVHVAAAVLALHHGARPAPGRASMPWVGPRHAEVTTQALGDQAATIHLRGGGLAAPLLLDATPQIHVFAGADREAVLRALSDGREGLDGPARAVIVAGSREELEARRADALRAAERNAPMPDGVFLRDRPVAGELAF

SEQ ID NO: 87 - protein, 869 aa, Aetherobacter fasciculatus; identical to SEQ ID NO: 86
  DOMAIN 1..869: "domain IIIa"
  SOURCE 1..869: /mol_type="protein" /organism="Aetherobacter fasciculatus"

SEQ ID NO: 88 - DNA, 3270 bp, Aetherobacter fasciculatus
  source 1..3270: /mol_type="DNA" /organism="Aetherobacter fasciculatus"
  CDS 1..3270: /codon_start=1 /gene="domain IIb" /transl_table=11
cagcagccggtccgccagctcgtgagcgccgtggcccagctcatcgccgccggcgtgcccgtcgccgccgacgccctcctcgccaggctcgcgccgcctcccccggcgcgcgcctcgggccccacgctcaccgtgcgcgctcaccctcctgacattcacttcccgacggcccctgccatgcaactgatgccgcccgcgccccttctcccgccggtgctcgccgacaaccccgcgccgcgcacggagcggagcttcaccgggcggtcggcgctgcgagaggacgcgcccgacggcgtcccctcgcctcgcctccccgtgttcgcgaggctcgcgccggtgttcacccacaccgagccggtgttcacgcacgtcgagccggcgctcgcgagccctgagccggcggtcacgcaccccgagccggtgatcgcgcacgccgagccggcgctcacacacgccgagcccgcgctcgcgagccccgcggatggccagcacgcctccatcgccgcgcgcggcgccgccgtgagcgcggggatcgccgccgcccatcgcgcctacgtcgaggcgcaaggcgccgtgcacgcccgcttcctcgcgctctcgggctccttgctctcgcgcctcgccgccgccccgacagccgccgccttcccggcgcctgctccctcgctcgcgccgcagcccgccgccctcccggcgcccgctccgcaggccgccccgccgcagcgcctcaccgcccccaccctcgtggtcgctcggccggtcgcgccgcccgccccgacgccggtgcccgccgccgtggccgcgttcgctcccgcgccgatctcggctccggcctccaccctgcccgcgccgtccctgctccgctccacgctccccgggcccaagttctcgcgcgcggatctcgaggtcctggcctcgggctcgatctcctcgatcttcggcccccagttcgccggccaggatggctatgccaaacaatgtcggatgccggagcccccgctcctgctcgccgatcgcgtcactggcatcgacgctgtccccggctcgatggacacgggcaccatctggaccgagaccgacgtcaagcacgacagctggtatctccaccagggccggatgccgactggcatcgtgatcgagtccggccaggcggatctcctcctgatctcctggctcggtatcgacgccctcaacaagggggagcgcgtctatcgcctcctcggctgcgaggccacctatcacggcgagctgccaaagccgggcgacacgctcgtctacgagatccacatcgacggccacgccgagcagggcgacgtgcggctgttcttcttccactacgactgccgcatcaacggcgagctgcggatctcggtgcgcaacggccaggccgggttcttcacctatcaagagctcgccaactccggcggagtgctctgggacgccgacggcgcgccccacgaggcgacaggccccctcgatccgcctcaagtgatctgcgagaagcagtccttcacctcggccgaggtcctcgccttctccgagggggacgcctacgcctgcttcgggcgcggcttcgagcgcgcgcagacgcacgtgcgcacgccgcgcatccaggacgggccgatgcggctcctcgatcgcgtcacccacttcgatcctcgcggcgggccctgggggcgcggctacctgcgcgccgaggccaagctctcgcccgacgactggttcttgcgagggcacttcaagaacgatccctgcatgccagggacgctgatcctcgaggcctgcgtgcaggccatggccttctatctctgcgccatgggctactccatcgatcgcgacggctggcgcttcgagcctgtccccggccagaagagcccgatgcgctgccgcggccaggccagcgtgacctcgcgggagatcgtctacgagatcttcgtccacgaggtcacgagcgggcctatccccagcgtcaaggtcgacatgctctgcaccgtcgacggcctcaaggccttccacggcgagcgcgtcggcctgcgcctcgtccccgcctggcccctcgacgactggcgacaggcccccgtcgccccgcagagcctgcaccgccgccccaagcagatcgcccctctcggcgggatcctcggccacgtcgagacccggccggtgccctcggtcaacggctttgccttcgactacgcctcgctcatcgcctgcgcctggggcaagccctcgcaggccttcgggccgatgtacgcgcccttcgacggcactcgccgcgtcgcccgcctgcccgggccgccttatcacttcatcacgcgcatcatctcggtcgagggcccgatcggcgtcccccagcccggcgccgaggtcgaggtcgagtacgacgtcccccacgacgcctggtatttcgcggagaacggcgcgcgcaccatgccgttctgcgtcctgctcgaggccgcgctccagccctgcggctggctggcgagctacatcggcagcgccctcaccaccgaggacgatctgctcttccgcaacctcgacgggactggcaccgtcctcgcggagatcacccccgagtccggcacgctgcgcacccacgtcaaggtggtcgaggtctcgcagtccgcggggatgatcatcgagaccttcgaagtcgagtgcttcgtcggcgaagcccacgtgtacacgctgcgcaccgtctttggcttcttccccaaatcggccttcgacaaccaggtcggactccccgtctccgccgaggcccgcgcccggatcgagcgtcaagccacctcgaccatcgatctggctccggagccgccgcgctacttcgccggcgcccctcgcctccccgaagcgatgctgtgcatgctcgatcgcatcaccgcgttcgagccgaccggcggcctcaagggccttggctatggccgcgccgagaagacggtcaaacccggggagtggtccttcaaagcccacttcttccaggatcccgtccagccgggctccctcggcctcgaggccctgctccagctccttcaggcgtggatgatcgacgccggtgacgccgagggtatcccgggcgcgcgcttcgaacccatcgccgtcggccgcccgatgacctggaaataccgcggccaggtcgtccccaagaacctcctcgtgacggtggagatcgacatcaccgagcgcggcaccgacgatcgcgggcgcttcgccctggccgagggctcgctctgggtcgacggcaagcgcatctacggcgcgaagaacctcggc

SEQ ID NO: 89 - protein, 1090 aa, Aetherobacter fasciculatus
  SOURCE 1..1090: /mol_type="protein" /note="This sequence is generated from feature [CDS]: 1..3270 placed under sequence number 88" /organism="Aetherobacter fasciculatus"
QQPVRQLVSAVAQLIAAGVPVAADALLARLAPPPPARASGPTLTVRAHPPDIHFPTAPAMQLMPPAPLLPPVLADNPAPRTERSFTGRSALREDAPDGVPSPRLPVFARLAPVFTHTEPVFTHVEPALASPEPAVTHPEPVIAHAEPALTHAEPALASPADGQHASIAARGAAVSAGIAAAHRAYVEAQGAVHARFLALSGSLLSRLAAAPTAAAFPAPAPSLAPQPAALPAPAPQAAPPQRLTAPTLVVARPVAPPAPTPVPAAVAAFAPAPISAPASTLPAPSLLRSTLPGPKFSRADLEVLASGSISSIFGPQFAGQDGYAKQCRMPEPPLLLADRVTGIDAVPGSMDTGTIWTETDVKHDSWYLHQGRMPTGIVIESGQADLLLISWLGIDALNKGERVYRLLGCEATYHGELPKPGDTLVYEIHIDGHAEQGDVRLFFFHYDCRINGELRISVRNGQAGFFTYQELANSGGVLWDADGAPHEATGPLDPPQVICEKQSFTSAEVLAFSEGDAYACFGRGFERAQTHVRTPRIQDGPMRLLDRVTHFDPRGGPWGRGYLRAEAKLSPDDWFLRGHFKNDPCMPGTLILEACVQAMAFYLCAMGYSIDRDGWRFEPVPGQKSPMRCRGQASVTSREIVYEIFVHEVTSGPIPSVKVDMLCTVDGLKAFHGERVGLRLVPAWPLDDWRQAPVAPQSLHRRPKQIAPLGGILGHVETRPVPSVNGFAFDYASLIACAWGKPSQAFGPMYAPFDGTRRVARLPGPPYHFITRIISVEGPIGVPQPGAEVEVEYDVPHDAWYFAENGARTMPFCVLLEAALQPCGWLASYIGSALTTEDDLLFRNLDGTGTVLAEITPESGTLRTHVKVVEVSQSAGMIIETFEVECFVGEAHVYTLRTVFGFFPKSAFDNQVGLPVSAEARARIERQATSTIDLAPEPPRYFAGAPRLPEAMLCMLDRITAFEPTGGLKGLGYGRAEKTVKPGEWSFKAHFFQDPVQPGSLGLEALLQLLQAWMIDAGDAEGIPGARFEPIAVGRPMTWKYRGQVVPKNLLVTVEIDITERGTDDRGRFALAEGSLWVDGKRIYGAKNLG

SEQ ID NO: 90 - protein, 1090 aa, Aetherobacter fasciculatus; identical to SEQ ID NO: 89
  DOMAIN 1..1090: "domain IIIb"
  SOURCE 1..1090: /mol_type="protein" /organism="Aetherobacter fasciculatus"

SEQ ID NO: 91 - DNA, 921 bp, Aetherobacter fasciculatus
  source 1..921: /mol_type="DNA" /organism="Aetherobacter fasciculatus"
  CDS 1..921: /codon_start=1 /gene="domain IV" /transl_table=11
gtcttcgcaggcgccgccgcggcgtacccgagcatgggccgcgccctcgcgctcgcgctccccgacgtgatggcgcgcctcggcaaccggctctcgacgctgcccgcggtgatcgactggatccacggcgcgccccgcgagccgcgccacccgctcgagcagctctgggcgtcgtcgttcctctgccagctccacgccgagatcacccgcgtcgacctcgggctccgccccagcgcgaccatcggctactcctccggcgagagcaatgcgctcttcgccatgggcgcctggcgcgacctcgacgccatgatgcacgaggcctggaccgagccgctgctgaccacggagctcgtcggcgactacgccgcggcgcgccgcctctgggcgcgctccggcgtcaccagccccgcggcgacgtgggccgcgtgggtcatcgccgcgcccgtggacgacgtgcgccgcgccctcacgggcgagccgctcgcgcacctcaccatcatcaacaccgccgaggagtgcgtgatcggcggcgaggcctccgcgtgcgaacgcgtcgtcgcgcggctcggcaagaacctcgcgctgccgctcagctacgccatggcctcgcactgccccgaggtcgccgaggcgcgcgaggcgtggatcaagatgcaccgccgcgccaccttcgacgtccccggcgtgcgcatctactccgccggcgccgagcaggccttcgcccccaccgccgacgccgccgcgatggccatcaccggccaggccgtcgacacgctcgatttcccccgcgtgatcgagcgcgcctacgccgacggcgtccgcgtcttcgtcgagcacggcccgcgcggcctctgcagccgctggatcgcgcgcatcctcggcgcgcgcgagcacctcgtcgtcccgctcgacgtcgccggg

SEQ ID NO: 92 - protein, 307 aa, Aetherobacter fasciculatus
  SOURCE 1..307: /mol_type="protein" /note="This sequence is generated from feature [CDS]: 1..921 placed under sequence number 91" /organism="Aetherobacter fasciculatus"
VFAGAAAAYPSMGRALALALPDVMARLGNRLSTLPAVIDWIHGAPREPRHPLEQLWASSFLCQLHAEITRVDLGLRPSATIGYSSGESNALFAMGAWRDLDAMMHEAWTEPLLTTELVGDYAAARRLWARSGVTSPAATWAAWVIAAPVDDVRRALTGEPLAHLTIINTAEECVIGGEASACERVVARLGKNLALPLSYAMASHCPEVAEAREAWIKMHRRATFDVPGVRIYSAGAEQAFAPTADAAAMAITGQAVDTLDFPRVIERAYADGVRVFVEHGPRGLCSRWIARILGAREHLVVPLDVAG

SEQ ID NO: 93 - protein, 307 aa, Aetherobacter fasciculatus; identical to SEQ ID NO: 92
  SOURCE 1..307: /mol_type="protein" /organism="Aetherobacter fasciculatus"

SEQ ID NO: 94 - DNA, 1113 bp, Aetherobacter fasciculatus
  source 1..1113: /mol_type="DNA" /organism="Aetherobacter fasciculatus"
  CDS 1..1113: /codon_start=1 /gene="domain IV*" /transl_table=11
atgcgcgtcgtcgccggccccgagcgcccgccgcccggctcgccgccttcgcccgcttcgccgaccgcgccgaccgcgcccccttcgccgcctgccccgacggtgccggctgcgctggctgcgccgccttcgcgcgatctcgcctcgtttcgaagcttctggcgcgcctcgatcggggtcgggccctggccgatcgaggacctctacatcgccctggtcgagcgcttcctcggccggatcgtcatcgccgatccggtcgccttctcgcgcgtccacggccgcggctgcctctacgtcgccaaccaccaggtcgcgctggagtcgctgatcttcatcatggtcgcctcggcgatctccggcacgcggacgatggcgctcgccaaggccgaacatcaggagtcgtggctcgggcgcctgatcacccgcggcatcgcctaccccggcgtcaccgatccaggcctcatcaccttcttcgaccgcgaggatcacgcctccttcgcccgcatcgccgagcaggccacgcgcgatctcgcggcctcgaccaagagcgtgctcgtccacgtcgagggcacgcgcgccatctcgtgccgcacccccgtcacccgcctcggcgcctcggtgatcgacatggcgctggccgccggcgcgcccatcgtcccggtccgcttcgcgcgcggcctgcccgagagcgactcccccgagcgcctcgatttcccgctcggctacggccgccaggacatctacttcggcgccccgatcgagcccgccgagctcgcgcgcctcccgctcaaggaccgcaaggacgccttgctcacggccctcaacacgctcggccccggcgcgagcgacacgccctccgaccccgacccgagcttcgccgcccaggtcgaggcctggcgagcccgcaccggctgcgccatcgaagatgccgtgttctatgccaccctcgccggagcgtcagccccggagtcggagggcgtgcagcggttactggagggcgcgagaacggggaagctggttatcgggagtggggagaaggatcgctggctgggggagtttgcgcggagcctgtttggatcggcggatgcgacgctcttggtggagggcggctga

SEQ ID NO: 95 - protein, 370 aa, Aetherobacter fasciculatus
  SOURCE 1..370: /mol_type="protein" /note="This sequence is generated from feature [CDS]: 1..1113 placed under sequence number 94" /organism="Aetherobacter fasciculatus"
MRVVAGPERPPPGSPPSPASPTAPTAPPSPPAPTVPAALAAPPSRDLASFRSFWRASIGVGPWPIEDLYIALVERFLGRIVIADPVAFSRVHGRGCLYVANHQVALESLIFIMVASAISGTRTMALAKAEHQESWLGRLITRGIAYPGVTDPGLITFFDREDHASFARIAEQATRDLAASTKSVLVHVEGTRAISCRTPVTRLGASVIDMALAAGAPIVPVRFARGLPESDSPERLDFPLGYGRQDIYFGAPIEPAELARLPLKDRKDALLTALNTLGPGASDTPSDPDPSFAAQVEAWRARTGCAIEDAVFYATLAGASAPESEGVQRLLEGARTGKLVIGSGEKDRWLGEFARSLFGSADATLLVEGG

SEQ ID NO: 96 - protein, 370 aa, Aetherobacter fasciculatus; identical to SEQ ID NO: 95
  DOMAIN 1..370: "domain IV*"
  SOURCE 1..370: /mol_type="protein" /organism="Aetherobacter fasciculatus"

SEQ ID NO: 97 - DNA, 16243 bp, Aetherobacter
  source 1..16243: /mol_type="DNA" /organism="Aetherobacter"
  CDS 1..1608: /codon_start=1 /product="pfa1" /transl_table=11
  CDS 1644..8342: /codon_start=1 /product="pfa2"
  CDS 8339..16243: /codon_start=1 /product="pfa3"
gtgtctgcaatcggtagatggaacgctcaagggggctcgcccgagctcacccctgcggcgatggtcgcggcgatagcgcgttgtcgagagtcgttgcacgtggtgcgcgacggggagtccgggcggatcggcctgggcgtggggggcgagctgctcccccccggcgagcgccgcgcgggcgagtacacgcttgtggcctcgctgccgccgctgttccccgagtggctcggtgaccgctcgttctgcgaggtgcacggggtccgcttcccctacgtcgccggcgagatggccaacggcattgccaccgtggagatggtcgtggccatgagccggagcgggatgctcggcttcttcggcgccgcgggcctgggcttctcccgggtcgaggccgcggtggagacgctccgcgccacgctgggggacgaggcgccgtggggggtgaacctcatccactcaccgaacgaggcctcgctggagaaccgcgtcgccgatctgctgatcgagagcggggtgcggcgcatctcggtgtcggccttcatggcgctgacgccggcggtggtgcgctgcgcggcgcgcgggctgcggctcgacgcggcggggcggatcgtgcggccgcggcacatcttcgccaagctctcgcggcgcgaggtggcgctgccgttcctctcgccggcgccggaggagatgctgcgcgccctcgtcgcgagcggcggcctgaccgaggaagaggcgcgcctcgccgcgaagatcccggtggccgaggacatcaccgtcgaggccgactccggcggtcacaccgacaaccaggcgctggtggcgctgctcccgacgatcttgcagctccgcgacgagctggcggacaagtacgactacacgcggccgatccgcgtcggcgcggccggcgggctcgggacgccgacggcggtcgccgcggcgttctcgctcggcgcggcctacgtcgtcaccggctcggtcaaccaggcggcgctggagtcgggcctctccgaggagggcaagcggatgctggcgcaggccgaggtcgccgacgtgatcatggcgcccgcggccgacatgttcgagctcggggtcaagctccaggtgctgcggcgcgggagcatgttcggcgtgcgcgcggccaagctctacgaggcgtaccacgcgcacccctcgctcgaggccatccccgacgcgctgcgagcgcggctcgagcgcgaggtcttgcacgcgaccttcgacgccatctgggcggagacgcgggccttctgggaggcgcgcgatcccgagcaggtcgcgctggcggcgcgggatcccaagcaccggatggcgctggtcttccgctggtacctcggcatggcgagccgctgggccatcgccggcgaggcctcgcggcgggccgactaccagatctggtgcgggccggcgatgggggccttcaactcctgggtccgcggctcgttcctcgaagatcccaagcagcgcggcgtggtggcgatcgcgctcaacttgctcgagggcgcggccgtcgtcacccgcgcccaccagctccgcacctacggcgtgcccgtgccggccgccgcgttcgactttcgacctcgtccgctcgcttgagcgctcggcttcaccttcactcgacaggtcttcgcatgactcaggttccggtcgccatcgtcggcgtgggcgcgctctttccgggctcgcccgacggtgcaggcttctggcgcgacatcgtcgcgtcacgcgatctcgtctccgacgtccccccggggcactggctgatcgaggactactacgatcccgatccctcggcgccggacaagacctactccaagcgcggggccttcctcggcgagacggccttcgatccgctggagttcggcgtggtgccgagctcgctcccgaccaccgacaccgcgcagctgctggcgctgatcgtggcgcggcgggtgctcgacgacgcgacccaggggcgcttcgcttccatcgatcggtcgcgcatcggcgtcgtcctcggcgtgacctcggggcaagagctcctcggcacgatggtgagccggctccagcggccggtgtggctcaaggcgctgcgcgacgacggcgtgcccgaggccgacgcgcagcggatctgcgatcgcatcaccaacgagtacgtgccctggaaggagtcgacgttccccgggctcctcggcaacgtggtcgccgggcgcatcgccaaccgcttcgatctcggcggcaccaactgcgtcaccgacgcggcgtgcgcgagctcgctcgcggcgctctcgatcgccatgaacgagctggcgctcgggcagtcggatctcgtgatcaccggcggggtggacacgatgaacgacatcctgatgtacacctgcttcagcaagaccccggccctctcgaagtcgggcgactgccgccccttctccgacgccgccgacgggacgctgctgggcgagggcctggcgatgttcgcgctcaagcgcctcaccgacgccgagcgcgacggggatcgcgtctacgcggtgatccgcggcctgggatcctcgtcggacgggcggagcaagagcgtgtacgcgccggtgccggaagggcaggccaaggcgctggtgcgggcctacgaggcggccggctacggcgcggacacggtggagctggtcgaggcgcacggcaccgcgaccaaggcgggcgacgcggcggagttcggcggcctcaagctggcgttcgaggcgagcgggcgcgcggatcaccagtggtgcgcgctcggatcggtcaaatcgcagatcgggcacaccaagtcggcggccggcgcggcgggcctcttcaaggcggtgatggcgctgcaccacaaggtcctgccgccgacgatcaaggtcgatcgccccaaccccgaattggcgatcgaggcgagcccgttctacctcaacacgcaggcgcggccctgggtgcgcaacgcgcagcacctgcggcgggcgtcggtctcgagcttcggcttcggcgggagcaacttccacgtgacgctggaggagtacgccggagcggcggagccggcggcgcgcctgcgcacggcgccgacggagctcttcgtgatctcggcgccctcggcggcggaggtcctcgcgcgcggcggcaagctcgccgagctcgcggacaaggagggcgcgacgacggcggcgcggacctcgcagcgcgacttcgtgacggcggatcacgcgcggctctcgatcgtggcgagcgacgccgcggatctgcgcgccaagctcgatcaggcgcgctcgctcctcggggcgcgccccgaggaggcgttctcgacgccgaccggcgtccacttcgcggtgggcgcggcggcgggcgacgtggcgttcctcttccccgggcagggcagccagtacgtgggcatgggcgccgacgtggccatggagcacaacgtcgcgctcgacgcgtgggacgcggcggcgggcctgatcgagaccgcggggctgcgcgacgtggtcttcccgcgcccggccttcaccgacgaggcgcgggcagagcaggcgcagctcctgacggcgaccgagtgggcgcagccggcgatcgccacggcgagcctcgcgctcctcgcggtgctgcgcgcggtcggcgtccgcccgtcgagcgtcgccggtcacagcctgggcgagctcaccgcgctcgccgcggccgatgctttgagcaccaacgatctcgtggccacggcgcgcaagcgcggccagctcatgaacgcggcctcgagcacgccgggggcgatgaccgcggtggcgcggcccctcgccgaggtgcaggccatcctcgcgcgcctccagagcgaggtggtggtggccaaccacaaccacccgacccaggtcgtcctcgccggcgagaccgccgcgatcgaggcggtcgaggccgagctcgcgcgccaggggatcaccgccaagcggctcccggtcgccacggcgttccacagccaggtcgtggccggggcgacggcgcccttcgccgagcacctcgccgggatcgcggtgaaggcgccggccatcgacgtgctctccaacagcgaggccgcggcgtacccgtcgtatcccgacgcggtgcgcgcgctcctcgccgggcagatcacgcgctcggtccgcttcgtcgaggtggtcgaggcgatgtgggcgcgcggggcgcgcatcttcgtggaggtcggcccctcggcggtgctgaccgagctctgcgcgcgcatcctcggcgagcggccgcacctggcgatcgccatggatcgcaagggcaagcacggcgtgaccgcgctccaggacgcgctcgggcgcctcgccgcggccggcgtggccatcgacttcgccccgctgtgggcgccgttcgggccgcccgcggcgccgaagcgggtcccggcgatgtcgatgatgatcaacggcgcgaactacgggaaggtctacccgcccaagggcggcgccgcggcgctgccgccgccgaacccgccgcggccggtcgttgctgctgcaacgatcgccgcggcgccgagctcggcggccaaggctccgatcgttgctgctgcaacgatcgccgcggcgccgagcccggcggcgaaggctccggtcgttgctgctgcaacgatcgcggcgcgccccgcggcggcgctcgagtcgcggccggtcgtcgcggctgcccctgctcctgctccggttgcggtggcgcccgcgtcgatggcggcggcgctgtcggcgccgggtcagctcggctggatcgaggcgtaccaggagtcgcagcggcagctcaccgacgcgcacgcgtcgtacgtgcggacgatggcgtcggggcacgaggcgttcctcacgacaatggaggcctcgttcatcggcctcggcggcctgctcggcgcgccggcttcggtgtccgcggtcgccccgcggagcacggcggctccgctgatcgcgcagcctgtcgcggtcgctccggcctcggtgatcgcgccggctccggtgcccgcgcccgctccggtgctcgctccggctccggctccggctccggctccggtgctcgcgcctgcgcctgtcgccgcggtagcgaaggcggctcccgcgccggtgatcgcgcccgcggcgccgtcgatcgatctccaggcgctgctgctcgacgtggtcgcggacaagaccggctaccccgccgagatgctcggcatgcacatggagctcgaggccgatctcggcatcgactccatcaagcgcgtcgagatcctctccgccatgcgcaagcgcgcgcccaaccttccggaggtcgtcgcctccgagatggccacgctccgtaccctcggacagatcgtcgagtacatgcgcgagcgatccggcgcgctgacggcgacgacgcacgagacgctggtccccgcgaccgcggaggctgcgacccaggcggctccggcgctcggcgatctccaggcgctgctgctcgacgtggtcgcggacaagaccggctaccccgccgagatgctcggcatgcacatggagctcgaggctgatctcggcatcgactccatcaagcgtgtcgagatcctctctgccatgcgcaagcgcgcgcccaacctccccgaggtcgtcgcctccgagatggccacgctccgcaccctcggacagatcgtcgagtacatgcgcgaccgctccggcgcgacggcggctccggtgaaagcagcgcccgcgcctgcgccggcgcctgcggcggctccgacgaaggaggcaccgacgctggcggatctgcaagcgctgctcctcagcgtcgtcgcggacaagaccggctaccccgccgagatgctcggtatgcacatggagctcgaggctgatctcggcatcgactccatcaagcgtgtcgagatcctctctgccatgcgcaagcgcgcgcccaacctccccgaggtcgtcgcctccgagatggccacgcttcgcaccctcggacagatcgtcgagtacatgcgcgaccgctccggcgggcacaacgtggcggccacgacgccggcgccggctccggctccggccaccgccacgactcccgctccggtggcgagcgcggcgccgagccgcatcggccgctacgtggtgggcacgcgcgaggaggcggcgagcgggctggcgatgggcggcgtgctcggcgcgcggcgcgtcgtcatcaccaacgaagggacgggcatcgcgcaggcgctggtgcgggcgctgcaagagcgcggcgtcagcagcgaggtcgtgaccgaggtgccggcggacgccgacgcggtggtgttcctcggcgggctgcggaccctcgtcgacgtcgacacggccatcgccatcaaccgcgaggccttcctcgcggcgcgcgcggtggccggcgtgttctcgcgcaacggtggcgccttcgtgacggtccaggacacgggcggcgatctcgggatcgaggcgcgcgagccgcgggcggcgtggctcgcgggcgtggccgcgctggcgcggacggcgcagctcgagtggccgaaggcctcggtgaaggccgtcgacgtcgagcgcggcgggcgcagctccgaggagatcgccgcggcgatcgccgaggagatcctcaccggcggcggcgcgctcgaggtcggcctgacggcggccggcgcgcggcgcgtgcccgaggtcgtgcagcgcgcggtgggcgagcggaccccggtcctcgctcgcagctcggtcgtcgtcgcctccggcggggcgcgcggcgtcaccgccacggcgctgatcgcgctggcgcgccacgcgcagccgaagctggtgatcctcgggcgatccgcgctcgaggcggagcccgcggcgtgcgtcggcgtgcgcggcgacgcggcgctcaagcgcgccttgctcgaggacgcgcgcgcgcagggccggacggcgaccatcgccgagatcggcgcccacgtggcgcgcatctccgcgagccgcgaggtgctggagacgctcgcggcgatcaaggccgcgggcggcgaggcgcgctacctcgccgtcgacgtcaccgacgccgatcgcctccgcgtcgcgctcgaggaggtccggcgcgactggggcccgatcaccgtcgtcgtccacggcgccggcgtcctcgccgacaagcggatcgaggacaaaacgcccgagcagttcgatcgggtcttcgataccaaggtcctcgggctgcgcgcgctcctcgccgcgaccgagggcgatccgctgcgcgcgatcatcctcttctcttcggtcgccgcgcgcgcgggcaacgtcggccagtgcgactacgccatggccaacgagatcctcaacaaggtggccatcaccgagcggcggcggcgcggcggcgcgtgcaccgtcaagtcgatcggctggggcccctgggagggcgggatggtgacgcccgcgctcaaggggcacttcgaatcgatgggcgtggcgctgatcccgctcgccgagggcgccgagcacttcatcgccgagatcgagggctccgccgaggagatcgagctggtgatcggtggcggcgccgacggcagcgccatccgcggcgacgccgagccgacgatccacttcggggtctcggtctcggatcgcacgagcccatggctcgccgatcaccgcgtcgcggggcgccgcgtcatccctgtcgccgtggtgatcgagtggttcactcgcgcggtcacggcgctccagggccgcgctgcggtgagcctccgcgacgtcaaggtgctgcgcgggatcaagctccccgccggggacgccgcggcctcgttcacgatcggctgccgcaagctcaccgatggaaagatcgagctcacgctccacggggccgacggcgccctgcactaccgcgcgagcgccgagcccagaggcgcagcgctgaagcccgagggcgccgcgcttccgctcgcggcgtggggcgatcggccgatctacgacggcgggctgctcttccacgggccgcgcttccacgccatccacagcatcgagggcgcctcggccgaggggatccgcgccacgctcaccggcgcgcgcgagctcggctggccgggcgaagcgcagcgcaccgacccggcgatcgtcgacggcgcgctccagctcgcgctgctctggacgcgcgagcgcctcggtcaggcctcgctcccgatggccatcgcggccttcgactggcaggcctcggggccggtcgaaggtccagtgcgcgcggtcgttcgagggcgcgaggccgacagcgcccacgctatctgcgacgtgtggctcgaggacgcgcgcggcgtgatcctcggcgccctccacggcgtcgagaccatcgtgcggcccgccgaggtccgcgcgccgcacctcgtggagacagggccggcctcgtgaccttcgaaccgatcgcgatcgtcgggcaggcctgcacgctccccggcgcgctgacgccggaggcgctgtgggccaacgttctccgcggcgagagcgccgtgacctcgccgccggagggccgctggcgcctcccggcgtggcacgcgatggggaagccgggcgcgcaggaagagcgcgcctggtccgacgccggaggctatgtccgcggcttcgattcggtcttcgatcccggcggcctgcgcctcccggaggccgagctccgcggcctcgatccggtgttccagtggacgctccacaccgcgcgcgcggccctgcgatccgcggggatggaggggccgtcggcgcgcgccgggctcgtcctcggcaacctctcgttcccgacggcgtcgatgtcgcgctacgccgagagcgtctggctcgaggcgctgggcaaggagctcctcggcgggcgcgcggcggcgcaggccggcgtcacccaccccgacgcgcacaaccgcttcatgtccgggctccccgcgcacctcgccgcgcaggccctcgggctcggcgggggcgccttcgcgctcgacgccgcctgcgcctcgtcgctctacgcgatcaagctcgcctgcgaccggctccaggatcgcgctgccgatctgatgctggccggcgccgtcaacgccgccgacagcctcttcctccacatcgggttctcggccctctcggcgatgagccgcaccggccagtcgcgcccgtttcaccgcgaggccgacggcctcgtcccctcggagggagccgtcttcttcgcgctccagcgcctcgacgacgcgcgcgccgccggccgccgcgtcctcgggatcatccgcggcatcggcctctccaacgacgggcgcggccgcggcctcctcgcgccctcggaggagggacagatccgcgccatgcgcctggcctacgccgcggcggggctcacgccctccgacgtgagcttcgtcgagtgccacgccaccggcacgcccgtcggtgacgccaccgagatccggagcctcagcgacgtcttcgccgggtgccgcgacgtgcccatcggctcgctcaagtccaacctcggccacctcatcaccgccgcgggcggcgccggcctgatcaaggtcctcggatcgttcaccgccgaaaccatcgcgccgacgatccacgctggggcttcgatccccgagctcgccgggtcgccggtccgcctcgtcacgcaggccgagccctggcgcgcggcgggccgccgcatcgccgcgatcagcgccttcgggttcggcggcaacaacgcccacctgatcgtcgagcaggacgacggccgcgccacagcgacgcgggccacagcgacgcgatccgcgccggcgccgatcgccgtcgtcagcctcggcgccaggatcggcgagaccaccggccgcgacgaggccgcgcgcgcgctgctctccggcgcgggctggggcagccgccgcgaggcggtcacggtcgagctcgaggggctgcgcttcccgccgcgcgatctcgagcagacgctcccgcagcagctcctcgtcctcgaagcggggcgcgaggcgatccgcgggctctcgctcccgcgcgatcgcaccgccgtgctcatcggcatgggcgccgatcccgaggtcgcgcgctacggcgctcgctggcgcctgcccgcgttcgccgacgcctgggcgacggccgggctccccgtgtcgagcgcctggaccgaggccgcgcgcgacgccgtgcaagagcagcacggcgcggccggcgtcgtcggcgccatgcccaacatccccgccaaccgcctcagcagccagctcgatctcgccgggccgagcttcaccatctcctcggaggagctctccggcgtcgtcgccttgcagctcgccgcgcgcgcgctgcgcagcggcgagatcgacgcggccctcgtcggcgccgtcgatctcgccgatcagatcgtccaccgccaggcgctgggcgagctcggcctcgagccccgcgccggcgacgccgcggtggcgctcgtgctcaagcgcctcaccgacgtgcgcaagagcgagaaggtcctggcgatcctcgacgagggcatcgtggacgcgtccagcgatcccgcgcgcctccgcgtcggcgacggcggcgccgatctcgatcccttcgcggccacgggcaagccgcacgcggcggcgggcctcgtccacgtcgccgccgccgtgctcgcgctgcaccacggcgcgcgccccgcccccgggcgcgcctccatgccctgggtcggcccccgccacgccgaggtgacgacgcaggccctcggcgatcaggcggcgacgatccacctccgcggcggcggccccgccgcgccgctgctgctcgacgccacgccgcagatccacgtcttcgccagcgccgatcgcgaggccgtgctccgcgccctcgccgacgggcgcgagggcctcgacggccccgcgcgcgcggtgatcgtggccggctcgcgcgaggagctcgaggcgcgccgcgccgacgccctccgcgccgccgagcgcaacgcccccatgcccgacggcgtcttcctccgcgatcgccccgtcgtcggcgagctcgccttcgtcttcgcgggcgccgccgcggcgtacccgagcatgggccgcgccctcgcgctcgcgctccccgacgtgatggcgcgcctcgggaaccggctctcgacgctgcccgcggtgatcgactggatccacggcgcgccgcgcgagccgcgccacccgctcgagcagctctgggcgtcgtcgttcctctgccagctccacgccgagatcacgcgcgtcgacctcgggctccgccccagcgcgaccatcggctactcctccggcgagagcaacgcgctcttcgccatgggcgcctggcgcgacctcgacgccatgatgcacgaggcctggaccgagccgctcctgacctcggagctcgtcggcgactacgccgcggcgcgccgcctctgggcgcgctccggcgtcaccagccccgcggcgacctgggccgcgtgggtcatcgccgcgcccgtggacgacgtgcgccgcgccctcgcaggcgagccgctcgcgcacctcaccatcatcaacaccgccgaggagtgcgtgatcggcggcgagtcctccgcgtgcgagcgcgtcgtcgcgcggctcggcaagaacctcgcgctgccgctcagctacgccatggcctcgcactgccccgaggtcgccgaggcgcgcgatgcgtggatcaagatgcaccgccgcgccaccttcgacgtccccggcgtgcgcatctactccgccggcgccgagcaggccttcgcccccacggccgacgccgccgcgatggccatcaccggccaggcggtggacacgctcgatttcccccgcgtgatcgagcgcgcctacgccgacggcgtccgcgtcttcgtcgagcacggcccgcgcggcctctgcagccgctggatcgcgcgcatcctcggcgcgcgcgagcacctcgtcgtcccgctcgacgtcgccgggcagcagccggtccgccagctcgtgagcgcggtcgcccagctcatcgccgccggcgtgcccgtcgccgccgacgccctcctcgccaggctcgcgccgcctcccccggcgcgctcctcgggccccacgctcaccgtgcgcgctcaccctcctgacattcacttcccgacggcccctgccatgcaactgatgccgcccgcgccccttctcccgccggtgctcgccgacaaccccgcgccgcgcacggagcggagcttcaccgggagggcggccatgcgagaggacgcgcccgacggcttcccgtcccctcgcctccccgtgttcgcgaggctcgcgccggtgttcacccacgccgagccggtgttcacgcacgtcgagcccgcgctcgcgagccacgagccggcggtcacgcccgccgagccggcggtcacgcctgccgagccggcggtcacgcacgccgagcctccgctcacgagccccgtggatggccagcacgcctccatcgccgcgcgcggcgctgccgtcagcgcggggatcgccgccgcgcaccgcgcttacgtcgaggcgcaaggcgccgtgcacgcccgcttcctcgcgctctcgggctccttgctctcgcgcctcgccgccgccccgaccgccgccgccttcccggcgcctgctccctcgcccgcgccgacagccgccctcccggcgcctgctccctcgctcccgccgcagcgcctcaccgcccccaccctcgtggtcgctcggccggtcgccccgcccgccccggcgcccgagcgcgccgccgtggccgcgttcgcccccgcgccgatctcggctccggcctccacgctgcccgcgccgtccctgctccgctccacgctccccgggcccaagttctcgcgcgcggatctcgaggtcctggcctccggctcgatctcctcgatcttcggcccccagttcgccggccaggatggctatgccaagcaatgtcggatgccggagcccccgctcctgctcgccgatcgcgtaactggcatcgacgctgtcccgggctcgatggacacaggcaccatctggaccgagaccgacgtcaagcacgacagctggtatctccaccagggccggatgccgacaggcatcgtgatcgagtccggccaggcggatctcctcctgatctcctggctcggtatcgacgccctcaacaagggtgagcgggtctatcgcctcctcggctgcgaggccacctatcacggcgagctcccgaagccgggcgacacgctcgtctacgagatccacatcgacggccacgccgagcagggcgacgtgcggctgttcttcttccactacgactgccgcatcaacggcgagctgcggatctcggtgcgcaacggccaggccgggttcttcacctatcaagagctcgccaactccggcggcgtgctctgggacgccgacggcgcgccgcacgaggcgacagggcccctcgatccgccgcaggtggtctgcgagaagcagtcgttcacctcggccgaggtcctcgccttctccgagggggacgcctacgcctgcttcgggcgcggcttcgagcgcgctcagacgcacgtgcgcaccccgcgcatccaggacgggccgatgcggctcctcgatcgcgtcacccacttcgatcctcgcggcgggccctggggtcgcggctacctgcgcgccgaggccaagctctcgcccgacgactggttcttgcgcgggcacttcaagaacgatccctgcatgccagggacgctgatcctcgaggcctgcgtgcaggccatggccttctatctctgcgccatgggctactccatcgatcgcgacggctggcgcttcgagcccgtccccggccagaagagcccgatgcgctgccgcggccaggccagcgtgacctcgcgggagatcgtctacgagatcttcgtccacgaggtcacgagcgggcctatccccagcgtcaaggtcgacatgctctgcaccgtcgacggcctcaaggccttccacggcgagcgcgtcggcctgcgcctcgtccccgcctggcccctcgacgactggcgacaggcccccgtcgccccgcagagcctgcaccgccgcgccaaggagatcgctcctctcggcgggatccgcggccacgtcgagaccaggccggtgccctcggtcaacggctttgccttcgactacgcctcgctcatcgcctgcgcctggggcaagccctcgcaggccttcgggccgatgtacgcgcccttcgacggcacccgccgcgtcgcccgcctgcccgggccgccttatcacttcatcacgcgcatcatctcggtcgagggcccgatcggcgtcccccagcccggcgccgaggtcgaggtcgagtacgacgtcccccacgacgcctggtatttcgcggagaacggcgcgcgcaccatgccgttctgtgtcctgctcgaggccgcgctccagccctgcggctggctggcgagctacatcggcagcgccctcaccaccgaggacgatctgctcttccgcaacctcgacgggactggcaccgtcctcgcggagatcacccccgagtccggcacgctgcgcacccacgtcaaggtggtcgaggtctcgcagtccgcggggatgatcatcgagaccttcgaagtcgagtgcttcgtcggcgaagcccacgtgtacacgctgcgcaccgtctttggcttcttccccaaatcggccttcgacaaccaggtcggcctccccgtctccgccgaggcccgcgcccggatcgagcgacaggccacctcgaccgtcgatctcgcctcggagccgccgcgctacttcggcggcgcccctcgcctccccgaagcgatgctgtgcatgctcgatcgcatcaccgcgttcgagccgaccggcggcctcaagggccttggctatggccgcgccgagaagacggtcaaacccggggagtggtccttcaaagcccacttcttccaggaccccgtccagcccggctcgctcggcctcgaggccatcctccagctcctccaggcgtggatgatcgacgccggcgacgccgagggcatccccggcgcgcgcttcgagcccatcgccgtcggccgcccgatgacctggaaataccgcggccaggtcgtccccaagaaccgcctcgtcacggtggagatcgacatcaccgagcgcggcaccgacgatcgcgggcgcttcgccctggccgagggctcgctctgggtcgacggcaagcgcatctacggcgcgaagaacctcggcatgcgcgtcgtcgccggccccgagcgcccgccgcccggctcgccgccttcgcccgcttcgccgaccgcgccgactgcgcccccttcgccgcctgccccgacggtgccggctgcgctggctgcgccgccttcgcgcgatctcgcctcgtttcgcagcttctggcgcgcctcgatcggggtcgggccctggccgatcgaggatctctacatcgcgctggtggagcgcttcctcggccggatcgtcatcgccgatccggtcgccttctcgcgcgtccacggccgcggctgcctcttcgtcgccaaccaccaggtcgcgctggagtcgctgatcttcatcatggtcgcctcggcgatctccggcacgaggacgatggcgctcgccaaggccgagcatcaagagtcgtggctcgggcgcctgatcacccggggcatcgcctaccccggcgtcaccgatccaggcctgatcaccttcttcgatcgcgaggatcacgcctccttcgcccgcatcgccgagcaggccacgcgcgatctcgcggcctcgaccaagagcgtgctcgtccacgtcgagggcacgcgcgccatctcgtgccgcacccccgtcacccgcctcggcgcctcggtgatcgacatggcgctcgccgccggcgcgcccatcgtcccggtccgcttcgcccgcggcctgcccgagagcgacgcccccgagcgcctcgatttccccctcggctacggccgccaggacatccacttcggcgccccgatcgagcccgccgatctcgcgcgcctcccgctcaaggaccgcaaggacgccttgctcgccgccctcaacacgctcggccccggctcgagcgacacgccctccgaccccgacccgagcttcgccgcccaggtcgaggcctggcgatcccgcaccggctgcgcgctcgaagatgccgtgttctatgccaccctcgccggagcgtcagccccggagtcggagggcgtgcagcggttactggagggggcgaggacggggaagctggctatcgggggcgaggcgaaggatcgctggctgggcgagtttgcgcggagcctgtttggatcggcggatgcgacgctcgtggtgcaggatggctga

SEQ ID NO: 98 - protein, 535 aa, Aetherobacter
  SOURCE 1..535: /mol_type="protein" /note="This sequence is generated from feature [CDS]: 1..1608 placed under sequence number 97" /organism="Aetherobacter"
VSAIGRWNAQGGSPELTPAAMVAAIARCRESLHVVRDGESGRIGLGVGGELLPPGERRAGEYTLVASLPPLFPEWLGDRSFCEVHGVRFPYVAGEMANGIATVEMVVAMSRSGMLGFFGAAGLGFSRVEAAVETLRATLGDEAPWGVNLIHSPNEASLENRVADLLIESGVRRISVSAFMALTPAVVRCAARGLRLDAAGRIVRPRHIFAKLSRREVALPFLSPAPEEMLRALVASGGLTEEEARLAAKIPVAEDITVEADSGGHTDNQALVALLPTILQLRDELADKYDYTRPIRVGAAGGLGTPTAVAAAFSLGAAYVVTGSVNQAALESGLSEEGKRMLAQAEVADVIMAPAADMFELGVKLQVLRRGSMFGVRAAKLYEAYHAHPSLEAIPDALRARLEREVLHATFDAIWAETRAFWEARDPEQVALAARDPKHRMALVFRWYLGMASRWAIAGEASRRADYQIWCGPAMGAFNSWVRGSFLEDPKQRGVVAIALNLLEGAAVVTRAHQLRTYGVPVPAAAFDFRPRPLA

SEQ ID NO: 99 - protein, 2232 aa, Aetherobacter
  SOURCE 1..2232: /mol_type="protein" /note="This sequence is generated from feature [CDS]: 1644..8342 placed under sequence number 97" /organism="Aetherobacter"
MTQVPVAIVGVGALFPGSPDGAGFWRDIVASRDLVSDVPPGHWLIEDYYDPDPSAPDKTYSKRGAFLGETAFDPLEFGVVPSSLPTTDTAQLLALIVARRVLDDATQGRFASIDRSRIGVVLGVTSGQELLGTMVSRLQRPVWLKALRDDGVPEADAQRICDRITNEYVPWKESTFPGLLGNVVAGRIANRFDLGGTNCVTDAACASSLAALSIAMNELALGQSDLVITGGVDTMNDILMYTCFSKTPALSKSGDCRPFSDAADGTLLGEGLAMFALKRLTDAERDGDRVYAVIRGLGSSSDGRSKSVYAPVPEGQAKALVRAYEAAGYGADTVELVEAHGTATKAGDAAEFGGLKLAFEASGRADHQWCALGSVKSQIGHTKSAAGAAGLFKAVMALHHKVLPPTIKVDRPNPELAIEASPFYLNTQARPWVRNAQHLRRASVSSFGFGGSNFHVTLEEYAGAAEPAARLRTAPTELFVISAPSAAEVLARGGKLAELADKEGATTAARTSQRDFVTADHARLSIVASDAADLRAKLDQARSLLGARPEEAFSTPTGVHFAVGAAAGDVAFLFPGQGSQYVGMGADVAMEHNVALDAWDAAAGLIETAGLRDVVFPRPAFTDEARAEQAQLLTATEWAQPAIATASLALLAVLRAVGVRPSSVAGHSLGELTALAAADALSTNDLVATARKRGQLMNAASSTPGAMTAVARPLAEVQAILARLQSEVVVANHNHPTQVVLAGETAAIEAVEAELARQGITAKRLPVATAFHSQVVAGATAPFAEHLAGIAVKAPAIDVLSNSEAAAYPSYPDAVRALLAGQITRSVRFVEVVEAMWARGARIFVEVGPSAVLTELCARILGERPHLAIAMDRKGKHGVTALQDALGRLAAAGVAIDFAPLWAPFGPPAAPKRVPAMSMMINGANYGKVYPPKGGAAALPPPNPPRPVVAAATIAAAPSSAAKAPIVAAATIAAAPSPAAKAPVVAAATIAARPAAALESRPVVAAAPAPAPVAVAPASMAAALSAPGQLGWIEAYQESQRQLTDAHASYVRTMASGHEAFLTTMEASFIGLGGLLGAPASVSAVAPRSTAAPLIAQPVAVAPASVIAPAPVPAPAPVLAPAPAPAPAPVLAPAPVAAVAKAAPAPVIAPAAPSIDLQALLLDVVADKTGYPAEMLGMHMELEADLGIDSIKRVEILSAMRKRAPNLPEVVASEMATLRTLGQIVEYMRERSGALTATTHETLVPATAEAATQAAPALGDLQALLLDVVADKTGYPAEMLGMHMELEADLGIDSIKRVEILSAMRKRAPNLPEVVASEMATLRTLGQIVEYMRDRSGATAAPVKAAPAPAPAPAAAPTKEAPTLADLQALLLSVVADKTGYPAEMLGMHMELEADLGIDSIKRVEILSAMRKRAPNLPEVVASEMATLRTLGQIVEYMRDRSGGHNVAATTPAPAPAPATATTPAPVASAAPSRIGRYVVGTREEAASGLAMGGVLGARRVVITNEGTGIAQALVRALQERGVSSEVVTEVPADADAVVFLGGLRTLVDVDTAIAINREAFLAARAVAGVFSRNGGAFVTVQDTGGDLGIEAREPRAAWLAGVAALARTAQLEWPKASVKAVDVERGGRSSEEIAAAIAEEILTGGGALEVGLTAAGARRVPEVVQRAVGERTPVLARSSVVVASGGARGVTATALIALARHAQPKLVILGRSALEAEPAACVGVRGDAALKRALLEDARAQGRTATIAEIGAHVARISASREVLETLAAIKAAGGEARYLAVDVTDADRLRVALEEVRRDWGPITVVVHGAGVLADKRIEDKTPEQFDRVFDTKVLGLRALLAATEGDPLRAIILFSSVAARAGNVGQCDYAMANEILNKVAITERRRRGGACTVKSIGWGPWEGGMVTPALKGHFESMGVALIPLAEGAEHFIAEIEGSAEEIELVIGGGADGSAIRGDAEPTIHFGVSVSDRTSPWLADHRVAGRRVIPVAVVIEWFTRAVTALQGRAAVSLRDVKVLRGIKLPAGDAAASFTIGCRKLTDGKIELTLHGADGALHYRASAEPRGAALKPEGAALPLAAWGDRPIYDGGLLFHGPRFHAIHSIEGASAEGIRATLTGARELGWPGEAQRTDPAIVDGALQLALLWTRERLGQASLPMAIAAFDWQASGPVEGPVRAVVRGREADSAHAICDVWLEDARGVILGALHGVETIVRPAEVRAPHLVETGPAS

SEQ ID NO: 100 - protein, 2634 aa, Aetherobacter
  SOURCE 1..2634: /mol_type="protein" /note="This sequence is generated from feature [CDS]: 8339..16243 placed under sequence number 97" /organism="Aetherobacter"
VTFEPIAIVGQACTLPGALTPEALWANVLRGESAVTSPPEGRWRLPAWHAMGKPGAQEERAWSDAGGYVRGFDSVFDPGGLRLPEAELRGLDPVFQWTLHTARAALRSAGMEGPSARAGLVLGNLSFPTASMSRYAESVWLEALGKELLGGRAAAQAGVTHPDAHNRFMSGLPAHLAAQALGLGGGAFALDAACASSLYAIKLACDRLQDRAADLMLAGAVNAADSLFLHIGFSALSAMSRTGQSRPFHREADGLVPSEGAVFFALQRLDDARAAGRRVLGIIRGIGLSNDGRGRGLLAPSEEGQIRAMRLAYAAAGLTPSDVSFVECHATGTPVGDATEIRSLSDVFAGCRDVPIGSLKSNLGHLITAAGGAGLIKVLGSFTAETIAPTIHAGASIPELAGSPVRLVTQAEPWRAAGRRIAAISAFGFGGNNAHLIVEQDDGRATATRATATRSAPAPIAVVSLGARIGETTGRDEAARALLSGAGWGSRREAVTVELEGLRFPPRDLEQTLPQQLLVLEAGREAIRGLSLPRDRTAVLIGMGADPEVARYGARWRLPAFADAWATAGLPVSSAWTEAARDAVQEQHGAAGVVGAMPNIPANRLSSQLDLAGPSFTISSEELSGVVALQLAARALRSGEIDAALVGAVDLADQIVHRQALGELGLEPRAGDAAVALVLKRLTDVRKSEKVLAILDEGIVDASSDPARLRVGDGGADLDPFAATGKPHAAAGLVHVAAAVLALHHGARPAPGRASMPWVGPRHAEVTTQALGDQAATIHLRGGGPAAPLLLDATPQIHVFASADREAVLRALADGREGLDGPARAVIVAGSREELEARRADALRAAERNAPMPDGVFLRDRPVVGELAFVFAGAAAAYPSMGRALALALPDVMARLGNRLSTLPAVIDWIHGAPREPRHPLEQLWASSFLCQLHAEITRVDLGLRPSATIGYSSGESNALFAMGAWRDLDAMMHEAWTEPLLTSELVGDYAAARRLWARSGVTSPAATWAAWVIAAPVDDVRRALAGEPLAHLTIINTAEECVIGGESSACERVVARLGKNLALPLSYAMASHCPEVAEARDAWIKMHRRATFDVPGVRIYSAGAEQAFAPTADAAAMAITGQAVDTLDFPRVIERAYADGVRVFVEHGPRGLCSRWIARILGAREHLVVPLDVAGQQPVRQLVSAVAQLIAAGVPVAADALLARLAPPPPARSSGPTLTVRAHPPDIHFPTAPAMQLMPPAPLLPPVLADNPAPRTERSFTGRAAMREDAPDGFPSPRLPVFARLAPVFTHAEPVFTHVEPALASHEPAVTPAEPAVTPAEPAVTHAEPPLTSPVDGQHASIAARGAAVSAGIAAAHRAYVEAQGAVHARFLALSGSLLSRLAAAPTAAAFPAPAPSPAPTAALPAPAPSLPPQRLTAPTLVVARPVAPPAPAPERAAVAAFAPAPISAPASTLPAPSLLRSTLPGPKFSRADLEVLASGSISSIFGPQFAGQDGYAKQCRMPEPPLLLADRVTGIDAVPGSMDTGTIWTETDVKHDSWYLHQGRMPTGIVIESGQADLLLISWLGIDALNKGERVYRLLGCEATYHGELPKPGDTLVYEIHIDGHAEQGDVRLFFFHYDCRINGELRISVRNGQAGFFTYQELANSGGVLWDADGAPHEATGPLDPPQVVCEKQSFTSAEVLAFSEGDAYACFGRGFERAQTHVRTPRIQDGPMRLLDRVTHFDPRGGPWGRGYLRAEAKLSPDDWFLRGHFKNDPCMPGTLILEACVQAMAFYLCAMGYSIDRDGWRFEPVPGQKSPMRCRGQASVTSREIVYEIFVHEVTSGPIPSVKVDMLCTVDGLKAFHGERVGLRLVPAWPLDDWRQAPVAPQSLHRRAKEIAPLGGIRGHVETRPVPSVNGFAFDYASLIACAWGKPSQAFGPMYAPFDGTRRVARLPGPPYHFITRIISVEGPIGVPQPGAEVEVEYDVPHDAWYFAENGARTMPFCVLLEAALQPCGWLASYIGSALTTEDDLLFRNLDGTGTVLAEITPESGTLRTHVKVVEVSQSAGMIIETFEVECFVGEAHVYTLRTVFGFFPKSAFDNQVGLPVSAEARARIERQATSTVDLASEPPRYFGGAPRLPEAMLCMLDRITAFEPTGGLKGLGYGRAEKTVKPGEWSFKAHFFQDPVQPGSLGLEAILQLLQAWMIDAGDAEGIPGARFEPIAVGRPMTWKYRGQVVPKNRLVTVEIDITERGTDDRGRFALAEGSLWVDGKRIYGAKNLGMRVVAGPERPPPGSPPSPASPTAPTAPPSPPAPTVPAALAAPPSRDLASFRSFWRASIGVGPWPIEDLYIALVERFLGRIVIADPVAFSRVHGRGCLFVANHQVALESLIFIMVASAISGTRTMALAKAEHQESWLGRLITRGIAYPGVTDPGLITFFDREDHASFARIAEQATRDLAASTKSVLVHVEGTRAISCRTPVTRLGASVIDMALAAGAPIVPVRFARGLPESDAPERLDFPLGYGRQDIHFGAPIEPADLARLPLKDRKDALLAALNTLGPGSSDTPSDPDPSFAAQVEAWRSRTGCALEDAVFYATLAGASAPESEGVQRLLEGARTGKLAIGGEAKDRWLGEFARSLFGSADATLVVQDG

SEQ ID NO: 101 - DNA, 1608 bp, Aetherobacter
  source 1..1608: /mol_type="DNA" /organism="Aetherobacter"
  CDS 1..1608: /codon_start=1 /product="domain pfa1" /transl_table=11
gtgtctgcaatcggtagatggaacgctcaagggggctcgcccgagctcacccctgcggcgatggtcgcggcgatagcgcgttgtcgagagtcgttgcacgtggtgcgcgacggggagtccgggcggatcggcctgggcgtggggggcgagctgctcccccccggcgagcgccgcgcgggcgagtacacgcttgtggcctcgctgccgccgctgttccccgagtggctcggtgaccgctcgttctgcgaggtgcacggggtccgcttcccctacgtcgccggcgagatggccaacggcattgccaccgtggagatggtcgtggccatgagccggagcgggatgctcggcttcttcggcgccgcgggcctgggcttctcccgggtcgaggccgcggtggagacgctccgcgccacgctgggggacgaggcgccgtggggggtgaacctcatccactcaccgaacgaggcctcgctggagaaccgcgtcgccgatctgctgatcgagagcggggtgcggcgcatctcggtgtcggccttcatggcgctgacgccggcggtggtgcgctgcgcggcgcgcgggctgcggctcgacgcggcggggcggatcgtgcggccgcggcacatcttcgccaagctctcgcggcgcgaggtggcgctgccgttcctctcgccggcgccggaggagatgctgcgcgccctcgtcgcgagcggcggcctgaccgaggaagaggcgcgcctcgccgcgaagatcccggtggccgaggacatcaccgtcgaggccgactccggcggtcacaccgacaaccaggcgctggtggcgctgctcccgacgatcttgcagctccgcgacgagctggcggacaagtacgactacacgcggccgatccgcgtcggcgcggccggcgggctcgggacgccgacggcggtcgccgcggcgttctcgctcggcgcggcctacgtcgtcaccggctcggtcaaccaggcggcgctggagtcgggcctctccgaggagggcaagcggatgctggcgcaggccgaggtcgccgacgtgatcatggcgcccgcggccgacatgttcgagctcggggtcaagctccaggtgctgcggcgcgggagcatgttcggcgtgcgcgcggccaagctctacgaggcgtaccacgcgcacccctcgctcgaggccatccccgacgcgctgcgagcgcggctcgagcgcgaggtcttgcacgcgaccttcgacgccatctgggcggagacgcgggccttctgggaggcgcgcgatcccgagcaggtcgcgctggcggcgcgggatcccaagcaccggatggcgctggtcttccgctggtacctcggcatggcgagccgctgggccatcgccggcgaggcctcgcggcgggccgactaccagatctggtgcgggccggcgatgggggccttcaactcctgggtccgcggctcgttcctcgaagatcccaagcagcgcggcgtggtggcgatcgcgctcaacttgctcgagggcgcggccgtcgtcacccgcgcccaccagctccgcacctacggcgtgcccgtgccggccgccgcgttcgactttcgacctcgtccgctcgcttga

SEQ ID NO: 102 - protein, 535 aa, Aetherobacter; identical to SEQ ID NO: 98
  SOURCE 1..535: /mol_type="protein" /note="This sequence is generated from feature [CDS]: 1..1608 placed under sequence number 101" /organism="Aetherobacter"

SEQ ID NO: 103 - DNA, 6699 bp, Aetherobacter
  source 1..6699: /mol_type="DNA" /organism="Aetherobacter"
  CDS 1..6699: /codon_start=1 /product="domain pfa2"
atgactcaggttccggtcgccatcgtcggcgtgggcgcgctctttccgggctcgcccgacggtgcaggcttctggcgcgacatcgtcgcgtcacgcgatctcgtctccgacgtccccccggggcactggctgatcgaggactactacgatcccgatccctcggcgccggacaagacctactccaagcgcggggccttcctcggcgagacggccttcgatccgctggagttcggcgtggtgccgagctcgctcccgaccaccgacaccgcgcagctgctggcgctgatcgtggcgcggcgggtgctcgacgacgcgacccaggggcgcttcgcttccatcgatcggtcgcgcatcggcgtcgtcctcggcgtgacctcggggcaagagctcctcggcacgatggtgagccggctccagcggccggtgtggctcaaggcgctgcgcgacgacggcgtgcccgaggccgacgcgcagcggatctgcgatcgcatcaccaacgagtacgtgccctggaaggagtcgacgttccccgggctcctcggcaacgtggtcgccgggcgcatcgccaaccgcttcgatctcggcggcaccaactgcgtcaccgacgcggcgtgcgcgagctcgctcgcggcgctctcgatcgccatgaacgagctggcgctcgggcagtcggatctcgtgatcaccggcggggtggacacgatgaacgacatcctgatgtacacctgcttcagcaagaccccggccctctcgaagtcgggcgactgccgccccttctccgacgccgccgacgggacgctgctgggcgagggcctggcgatgttcgcgctcaagcgcctcaccgacgccgagcgcgacggggatcgcgtctacgcggtgatccgcggcctgggatcctcgtcggacgggcggagcaagagcgtgtacgcgccggtgccggaagggcaggccaaggcgctggtgcgggcctacgaggcggccggctacggcgcggacacggtggagctggtcgaggcgcacggcaccgcgaccaaggcgggcgacgcggcggagttcggcggcctcaagctggcgttcgaggcgagcgggcgcgcggatcaccagtggtgcgcgctcggatcggtcaaatcgcagatcgggcacaccaagtcggcggccggcgcggcgggcctcttcaaggcggtgatggcgctgcaccacaaggtcctgccgccgacgatcaaggtcgatcgccccaaccccgaattggcgatcgaggcgagcccgttctacctcaacacgcaggcgcggccctgggtgcgcaacgcgcagcacctgcggcgggcgtcggtctcgagcttcggcttcggcgggagcaacttccacgtgacgctggaggagtacgccggagcggcggagccggcggcgcgcctgcgcacggcgccgacggagctcttcgtgatctcggcgccctcggcggcggaggtcctcgcgcgcggcggcaagctcgccgagctcgcggacaaggagggcgcgacgacggcggcgcggacctcgcagcgcgacttcgtgacggcggatcacgcgcggctctcgatcgtggcgagcgacgccgcggatctgcgcgccaagctcgatcaggcgcgctcgctcctcggggcgcgccccgaggaggcgttctcgacgccgaccggcgtccacttcgcggtgggcgcggcggcgggcgacgtggcgttcctcttccccgggcagggcagccagtacgtgggcatgggcgccgacgtggccatggagcacaacgtcgcgctcgacgcgtgggacgcggcggcgggcctgatcgagaccgcggggctgcgcgacgtggtcttcccgcgcccggccttcaccgacgaggcgcgggcagagcaggcgcagctcctgacggcgaccgagtgggcgcagccggcgatcgccacggcgagcctcgcgctcctcgcggtgctgcgcgcggtcggcgtccgcccgtcgagcgtcgccggtcacagcctgggcgagctcaccgcgctcgccgcggccgatgctttgagcaccaacgatctcgtggccacggcgcgcaagcgcggccagctcatgaacgcggcctcgagcacgccgggggcgatgaccgcggtggcgcggcccctcgccgaggtgcaggccatcctcgcgcgcctccagagcgaggtggtggtggccaaccacaaccacccgacccaggtcgtcctcgccggcgagaccgccgcgatcgaggcggtcgaggccgagctcgcgcgccaggggatcaccgccaagcggctcccggtcgccacggcgttccacagccaggtcgtggccggggcgacggcgcccttcgccgagcacctcgccgggatcgcggtgaaggcgccggccatcgacgtgctctccaacagcgaggccgcggcgtacccgtcgtatcccgacgcggtgcgcgcgctcctcgccgggcagatcacgcgctcggtccgcttcgtcgaggtggtcgaggcgatgtgggcgcgcggggcgcgcatcttcgtggaggtcggcccctcggcggtgctgaccgagctctgcgcgcgcatcctcggcgagcggccgcacctggcgatcgccatggatcgcaagggcaagcacggcgtgaccgcgctccaggacgcgctcgggcgcctcgccgcggccggcgtggccatcgacttcgccccgctgtgggcgccgttcgggccgcccgcggcgccgaagcgggtcccggcgatgtcgatgatgatcaacggcgcgaactacgggaaggtctacccgcccaagggcggcgccgcggcgctgccgccgccgaacccgccgcggccggtcgttgctgctgcaacgatcgccgcggcgccgagctcggcggccaaggctccgatcgttgctgctgcaacgatcgccgcggcgccgagcccggcggcgaaggctccggtcgttgctgctgcaacgatcgcggcgcgccccgcggcggcgctcgagtcgcggccggtcgtcgcggctgcccctgctcctgctccggttgcggtggcgcccgcgtcgatggcggcggcgctgtcggcgccgggtcagctcggctggatcgaggcgtaccaggagtcgcagcggcagctcaccgacgcgcacgcgtcgtacgtgcggacgatggcgtcggggcacgaggcgttcctcacgacaatggaggcctcgttcatcggcctcggcggcctgctcggcgcgccggcttcggtgtccgcggtcgccccgcggagcacggcggctccgctgatcgcgcagcctgtcgcggtcgctccggcctcggtgatcgcgccggctccggtgcccgcgcccgctccggtgctcgctccggctccggctccggctccggctccggtgctcgcgcctgcgcctgtcgccgcggtagcgaaggcggctcccgcgccggtgatcgcgcccgcggcgccgtcgatcgatctccaggcgctgctgctcgacgtggtcgcggacaagaccggctaccccgccgagatgctcggcatgcacatggagctcgaggccgatctcggcatcgactccatcaagcgcgtcgagatcctctccgccatgcgcaagcgcgcgcccaaccttccggaggtcgtcgcctccgagatggccacgctccgtaccctcggacagatcgtcgagtacatgcgcgagcgatccggcgcgctgacggcgacgacgcacgagacgctggtccccgcgaccgcggaggctgcgacccaggcggctccggcgctcggcgatctccaggcgctgctgctcgacgtggtcgcggacaagaccggctaccccgccgagatgctcggcatgcacatggagctcgaggctgatctcggcatcgactccatcaagcgtgtcgagatcctctctgccatgcgcaagcgcgcgcccaacctccccgaggtcgtcgcctccgagatggccacgctccgcaccctcggacagatcgtcgagtacatgcgcgaccgctccggcgcgacggcggctccggtgaaagcagcgcccgcgcctgcgccggcgcctgcggcggctccgacgaaggaggcaccgacgctggcggatctgcaagcgctgctcctcagcgtcgtcgcggacaagaccggctaccccgccgagatgctcggtatgcacatggagctcgaggctgatctcggcatcgactccatcaagcgtgtcgagatcctctctgccatgcgcaagcgcgcgcccaacctccccgaggtcgtcgcctccgagatggccacgcttcgcaccctcggacagatcgtcgagtacatgcgcgaccgctccggcgggcacaacgtggcggccacgacgccggcgccggctccggctccggccaccgccacgactcccgctccggtggcgagcgcggcgccgagccgcatcggccgctacgtggtgggcacgcgcgaggaggcggcgagcgggctggcgatgggcggcgtgctcggcgcgcggcgcgtcgtcatcaccaacgaagggacgggcatcgcgcaggcgctggtgcgggcgctgcaagagcgcggcgtcagcagcgaggtcgtgaccgaggtgccggcggacgccgacgcggtggtgttcctcggcgggctgcggaccctcgtcgacgtcgacacggccatcgccatcaaccgcgaggccttcctcgcggcgcgcgcggtggccggcgtgttctcgcgcaacggtggcgccttcgtgacggtccaggacacgggcggcgatctcgggatcgaggcgcgcgagccgcgggcggcgtggctcgcgggcgtggccgcgctggcgcggacggcgcagctcgagtggccgaaggcctcggtgaaggccgtcgacgtcgagcgcggcgggcgcagctccgaggagatcgccgcggcgatcgccgaggagatcctcaccggcggcggcgcgctcgaggtcggcctgacggcggccggcgcgcggcgcgtgcccgaggtcgtgcagcgcgcggtgggcgagcggaccccggtcctcgctcgcagctcggtcgtcgtcgcctccggcggggcgcgcggcgtcaccgccacggcgctgatcgcgctggcgcgccacgcgcagccgaagctggtgatcctcgggcgatccgcgctcgaggcggagcccgcggcgtgcgtcggcgtgcgcggcgacgcggcgctcaagcgcgccttgctcgaggacgcgcgcgcgcagggccggacggcgaccatcgccgagatcggcgcccacgtggcgcgcatctccgcgagccgcgaggtgctggagacgctcgcggcgatcaaggccgcgggcggcgaggcgcgctacctcgccgtcgacgtcaccgacgccgatcgcctccgcgtcgcgctcgaggaggtccggcgcgactggggcccgatcaccgtcgtcgtccacggcgccggcgtcctcgccgacaagcggatcgaggacaaaacgcccgagcagttcgatcgggtcttcgataccaaggtcctcgggctgcgcgcgctcctcgccgcgaccgagggcgatccgctgcgcgcgatcatcctcttctcttcggtcgccgcgcgcgcgggcaacgtcggccagtgcgactacgccatggccaacgagatcctcaacaaggtggccatcaccgagcggcggcggcgcggcggcgcgtgcaccgtcaagtcgatcggctggggcccctgggagggcgggatggtgacgcccgcgctcaaggggcacttcgaatcgatgggcgtggcgctgatcccgctcgccgagggcgccgagcacttcatcgccgagatcgagggctccgccgaggagatcgagctggtgatcggtggcggcgccgacggcagcgccatccgcggcgacgccgagccgacgatccacttcggggtctcggtctcggatcgcacgagcccatggctcgccgatcaccgcgtcgcggggcgccgcgtcatccctgtcgccgtggtgatcgagtggttcactcgcgcggtcacggcgctccagggccgcgctgcggtgagcctccgcgacgtcaaggtgctgcgcgggatcaagctccccgccggggacgccgcggcctcgttcacgatcggctgccgcaagctcaccgatggaaagatcgagctcacgctccacggggccgacggcgccctgcactaccgcgcgagcgccgagcccagaggcgcagcgctgaagcccgagggcgccgcgcttccgctcgcggcgtggggcgatcggccgatctacgacggcgggctgctcttccacgggccgcgcttccacgccatccacagcatcgagggcgcctcggccgaggggatccgcgccacgctcaccggcgcgcgcgagctcggctggccgggcgaagcgcagcgcaccgacccggcgatcgtcgacggcgcgctccagctcgcgctgctctggacgcgcgagcgcctcggtcaggcctcgctcccgatggccatcgcggccttcgactggcaggcctcggggccggtcgaaggtccagtgcgcgcggtcgttcgagggcgcgaggccgacagcgcccacgctatctgcgacgtgtggctcgaggacgcgcgcggcgtgatcctcggcgccctccacggcgtcgagaccatcgtgcggcccgccgaggtccgcgcgccgcacctcgtggagacagggccggcctcgtga

SEQ ID NO: 104 - protein, 2232 aa, Aetherobacter; identical to SEQ ID NO: 99
  SOURCE 1..2232: /mol_type="protein" /note="This sequence is generated from feature [CDS]: 1..6699 placed under sequence number 103" /organism="Aetherobacter"

SEQ ID NO: 105 - DNA, 7905 bp, Aetherobacter
  source 1..7905: /mol_type="DNA" /organism="Aetherobacter"
  CDS 1..7905: /codon_start=1 /product="domain pfa3"
gtgaccttcgaaccgatcgcgatcgtcgggcaggcctgcacgctccccggcgcgctgacgccggaggcgctgtgggccaacgttctccgcggcgagagcgccgtgacctcgccgccggagggccgctggcgcctcccggcgtggcacgcgatggggaagccgggcgcgcaggaagagcgcgcctggtccgacgccggaggctatgtccgcggcttcgattcggtcttcgatcccggcggcctgcgcctcccggaggccgagctccgcggcctcgatccggtgttccagtggacgctccacaccgcgcgcgcggccctgcgatccgcggggatggaggggccgtcggcgcgcgccgggctcgtcctcggcaacctctcgttcccgacggcgtcgatgtcgcgctacgccgagagcgtctggctcgaggcgctgggcaaggagctcctcggcgggcgcgcggcggcgcaggccggcgtcacccaccccgacgcgcacaaccgcttcatgtccgggctccccgcgcacctcgccgcgcaggccctcgggctcggcgggggcgccttcgcgctcgacgccgcctgcgcctcgtcgctctacgcgatcaagctcgcctgcgaccggctccaggatcgcgctgccgatctgatgctggccggcgccgtcaacgccgccgacagcctcttcctccacatcgggttctcggccctctcggcgatgagccgcaccggccagtcgcgcccgtttcaccgcgaggccgacggcctcgtcccctcggagggagccgtcttcttcgcgctccagcgcctcgacgacgcgcgcgccgccggccgccgcgtcctcgggatcatccgcggcatcggcctctccaacgacgggcgcggccgcggcctcctcgcgccctcggaggagggacagatccgcgccatgcgcctggcctacgccgcggcggggctcacgccctccgacgtgagcttcgtcgagtgccacgccaccggcacgcccgtcggtgacgccaccgagatccggagcctcagcgacgtcttcgccgggtgccgcgacgtgcccatcggctcgctcaagtccaacctcggccacctcatcaccgccgcgggcggcgccggcctgatcaaggtcctcggatcgttcaccgccgaaaccatcgcgccgacgatccacgctggggcttcgatccccgagctcgccgggtcgccggtccgcctcgtcacgcaggccgagccctggcgcgcggcgggccgccgcatcgccgcgatcagcgccttcgggttcggcggcaacaacgcccacctgatcgtcgagcaggacgacggccgcgccacagcgacgcgggccacagcgacgcgatccgcgccggcgccgatcgccgtcgtcagcctcggcgccaggatcggcgagaccaccggccgcgacgaggccgcgcgcgcgctgctctccggcgcgggctggggcagccgccgcgaggcggtcacggtcgagctcgaggggctgcgcttcccgccgcgcgatctcgagcagacgctcccgcagcagctcctcgtcctcgaagcggggcgcgaggcgatccgcgggctctcgctcccgcgcgatcgcaccgccgtgctcatcggcatgggcgccgatcccgaggtcgcgcgctacggcgctcgctggcgcctgcccgcgttcgccgacgcctgggcgacggccgggctccccgtgtcgagcgcctggaccgaggccgcgcgcgacgccgtgcaagagcagcacggcgcggccggcgtcgtcggcgccatgcccaacatccccgccaaccgcctcagcagccagctcgatctcgccgggccgagcttcaccatctcctcggaggagctctccggcgtcgtcgccttgcagctcgccgcgcgcgcgctgcgcagcggcgagatcgacgcggccctcgtcggcgccgtcgatctcgccgatcagatcgtccaccgccaggcgctgggcgagctcggcctcgagccccgcgccggcgacgccgcggtggcgctcgtgctcaagcgcctcaccgacgtgcgcaagagcgagaaggtcctggcgatcctcgacgagggcatcgtggacgcgtccagcgatcccgcgcgcctccgcgtcggcgacggcggcgccgatctcgatcccttcgcggccacgggcaagccgcacgcggcggcgggcctcgtccacgtcgccgccgccgtgctcgcgctgcaccacggcgcgcgccccgcccccgggcgcgcctccatgccctgggtcggcccccgccacgccgaggtgacgacgcaggccctcggcgatcaggcggcgacgatccacctccgcggcggcggccccgccgcgccgctgctgctcgacgccacgccgcagatccacgtcttcgccagcgccgatcgcgaggccgtgctccgcgccctcgccgacgggcgcgagggcctcgacggccccgcgcgcgcggtgatcgtggccggctcgcgcgaggagctcgaggcgcgccgcgccgacgccctccgcgccgccgagcgcaacgcccccatgcccgacggcgtcttcctccgcgatcgccccgtcgtcggcgagctcgccttcgtcttcgcgggcgccgccgcggcgtacccgagcatgggccgcgccctcgcgctcgcgctccccgacgtgatggcgcgcctcgggaaccggctctcgacgctgcccgcggtgatcgactggatccacggcgcgccgcgcgagccgcgccacccgctcgagcagctctgggcgtcgtcgttcctctgccagctccacgccgagatcacgcgcgtcgacctcgggctccgccccagcgcgaccatcggctactcctccggcgagagcaacgcgctcttcgccatgggcgcctggcgcgacctcgacgccatgatgcacgaggcctggaccgagccgctcctgacctcggagctcgtcggcgactacgccgcggcgcgccgcctctgggcgcgctccggcgtcaccagccccgcggcgacctgggccgcgtgggtcatcgccgcgcccgtggacgacgtgcgccgcgccctcgcaggcgagccgctcgcgcacctcaccatcatcaacaccgccgaggagtgcgtgatcggcggcgagtcctccgcgtgcgagcgcgtcgtcgcgcggctcggcaagaacctcgcgctgccgctcagctacgccatggcctcgcactgccccgaggtcgccgaggcgcgcgatgcgtggatcaagatgcaccgccgcgccaccttcgacgtccccggcgtgcgcatctactccgccggcgccgagcaggccttcgcccccacggccgacgccgccgcgatggccatcaccggccaggcggtggacacgctcgatttcccccgcgtgatcgagcgcgcctacgccgacggcgtccgcgtcttcgtcgagcacggcccgcgcggcctctgcagccgctggatcgcgcgcatcctcggcgcgcgcgagcacctcgtcgtcccgctcgacgtcgccgggcagcagccggtccgccagctcgtgagcgcggtcgcccagctcatcgccgccggcgtgcccgtcgccgccgacgccctcctcgccaggctcgcgccgcctcccccggcgcgctcctcgggccccacgctcaccgtgcgcgctcaccctcctgacattcacttcccgacggcccctgccatgcaactgatgccgcccgcgccccttctcccgccggtgctcgccgacaaccccgcgccgcgcacggagcggagcttcaccgggagggcggccatgcgagaggacgcgcccgacggcttcccgtcccctcgcctccccgtgttcgcgaggctcgcgccggtgttcacccacgccgagccggtgttcacgcacgtcgagcccgcgctcgcgagccacgagccggcggtcacgcccgccgagccggcggtcacgcctgccgagccggcggtcacgcacgccgagcctccgctcacgagccccgtggatggccagcacgcctccatcgccgcgcgcggcgctgccgtcagcgcggggatcgccgccgcgcaccgcgcttacgtcgaggcgcaaggcgccgtgcacgcccgcttcctcgcgctctcgggctccttgctctcgcgcctcgccgccgccccgaccgccgccgccttcccggcgcctgctccctcgcccgcgccgacagccgccctcccggcgcctgctccctcgctcccgccgcagcgcctcaccgcccccaccctcgtggtcgctcggccggtcgccccgcccgccccggcgcccgagcgcgccgccgtggccgcgttcgcccccgcgccgatctcggctccggcctccacgctgcccgcgccgtccctgctccgctccacgctccccgggcccaagttctcgcgcgcggatctcgaggtcctggcctccggctcgatctcctcgatcttcggcccccagttcgccggccaggatggctatgccaagcaatgtcggatgccggagcccccgctcctgctcgccgatcgcgtaactggcatcgacgctgtcccgggctcgatggacacaggcaccatctggaccgagaccgacgtcaagcacgacagctggtatctccaccagggccggatgccgacaggcatcgtgatcgagtccggccaggcggatctcctcctgatctcctggctcggtatcgacgccctcaacaagggtgagcgggtctatcgcctcctcggctgcgaggccacctatcacggcgagctcccgaagccgggcgacacgctcgtctacgagatccacatcgacggccacgccgagcagggcgacgtgcggctgttcttcttccactacgactgccgcatcaacggcgagctgcggatctcggtgcgcaacggccaggccgggttcttcacctatcaagagctcgccaactccggcggcgtgctctgggacgccgacggcgcgccgcacgaggcgacagggcccctcgatccgccgcaggtggtctgcgagaagcagtcgttcacctcggccgaggtcctcgccttctccgagggggacgcctacgcctgcttcgggcgcggcttcgagcgcgctcagacgcacgtgcgcaccccgcgcatccaggacgggccgatgcggctcctcgatcgcgtcacccacttcgatcctcgcggcgggccctggggtcgcggctacctgcgcgccgaggccaagctctcgcccgacgactggttcttgcgcgggcacttcaagaacgatccctgcatgccagggacgctgatcctcgaggcctgcgtgcaggccatggccttctatctctgcgccatgggctactccatcgatcgcgacggctggcgcttcgagcccgtccccggccagaagagcccgatgcgctgccgcggccaggccagcgtgacctcgcgggagatcgtctacgagatcttcgtccacgaggtcacgagcgggcctatccccagcgtcaaggtcgacatgctctgcaccgtcgacggcctcaaggccttccacggcgagcgcgtcggcctgcgcctcgtccccgcctggcccctcgacgactggcgacaggcccccgtcgccccgcagagcctgcaccgccgcgccaaggagatcgctcctctcggcgggatccgcggccacgtcgagaccaggccggtgccctcggtcaacggctttgccttcgactacgcctcgctcatcgcctgcgcctggggcaagccctcgcaggccttcgggccgatgtacgcgcccttcgacggcacccgccgcgtcgcccgcctgcccgggccgccttatcacttcatcacgcgcatcatctcggtcgagggcccgatcggcgtcccccagcccggcgccgaggtcgaggtcgagtacgacgtcccccacgacgcctggtatttcgcggagaacggcgcgcgcaccatgccgttctgtgtcctgctcgaggccgcgctccagccctgcggctggctggcgagctacatcggcagcgccctcaccaccgaggacgatctgctcttccgcaacctcgacgggactggcaccgtcctcgcggagatcacccccgagtccggcacgctgcgcacccacgtcaaggtggtcgaggtctcgcagtccgcggggatgatcatcgagaccttcgaagtcgagtgcttcgtcggcgaagcccacgtgtacacgctgcgcaccgtctttggcttcttccccaaatcggccttcgacaaccaggtcggcctccccgtctccgccgaggcccgcgcccggatcgagcgacaggccacctcgaccgtcgatctcgcctcggagccgccgcgctacttcggcggcgcccctcgcctccccgaagcgatgctgtgcatgctcgatcgcatcaccgcgttcgagccgaccggcggcctcaagggccttggctatggccgcgccgagaagacggtcaaacccggggagtggtccttcaaagcccacttcttccaggaccccgtccagcccggctcgctcggcctcgaggccatcctccagctcctccaggcgtggatgatcgacgccggcgacgccgagggcatccccggcgcgcgcttcgagcccatcgccgtcggccgcccgatgacctggaaataccgcggccaggtcgtccccaagaaccgcctcgtcacggtggagatcgacatcaccgagcgcggcaccgacgatcgcgggcgcttcgccctggccgagggctcgctctgggtcgacggcaagcgcatctacggcgcgaagaacctcggcatgcgcgtcgtcgccggccccgagcgcccgccgcccggctcgccgccttcgcccgcttcgccgaccgcgccgactgcgcccccttcgccgcctgccccgacggtgccggctgcgctggctgcgccgccttcgcgcgatctcgcctcgtttcgcagcttctggcgcgcctcgatcggggtcgggccctggccgatcgaggatctctacatcgcgctggtggagcgcttcctcggccggatcgtcatcgccgatccggtcgccttctcgcgcgtccacggccgcggctgcctcttcgtcgccaaccaccaggtcgcgctggagtcgctgatcttcatcatggtcgcctcggcgatctccggcacgaggacgatggcgctcgccaaggccgagcatcaagagtcgtggctcgggcgcctgatcacccggggcatcgcctaccccggcgtcaccgatccaggcctgatcaccttcttcgatcgcgaggatcacgcctccttcgcccgcatcgccgagcaggccacgcgcgatctcgcggcctcgaccaagagcgtgctcgtccacgtcgagggcacgcgcgccatctcgtgccgcacccccgtcacccgcctcggcgcctcggtgatcgacatggcgctcgccgccggcgcgcccatcgtcccggtccgcttcgcccgcggcctgcccgagagcgacgcccccgagcgcctcgatttccccctcggctacggccgccaggacatccacttcggcgccccgatcgagcccgccgatctcgcgcgcctcccgctcaaggaccgcaaggacgccttgctcgccgccctcaacacgctcggccccggctcgagcgacacgccctccgaccccgacccgagcttcgccgcccaggtcgaggcctggcgatcccgcaccggctgcgcgctcgaagatgccgtgttctatgccaccctcgccggagcgtcagccccggagtcggagggcgtgcagcggttactggagggggcgaggacggggaagctggctatcgggggcgaggcgaaggatcgctggctgggcgagtttgcgcggagcctgtttggatcggcggatgcgacgctcgtggtgcaggatggctga

SEQ ID NO: 106 - protein, 2634 aa, Aetherobacter; identical to SEQ ID NO: 100
  SOURCE 1..2634: /mol_type="protein" /note="This sequence is generated from feature [CDS]: 1..7905 placed under sequence number 105" /organism="Aetherobacter"

SEQ ID NO: 107 - DNA, 1608 bp, Aetherobacter; identical to SEQ ID NO: 101
  source 1..1608: /mol_type="DNA" /organism="Aetherobacter"
  CDS 1..1608: /codon_start=1 /product="domain I" /transl_table=11

SEQ ID NO: 108 - protein, 535 aa, Aetherobacter; identical to SEQ ID NO: 98
  SOURCE 1..535: /mol_type="protein" /note="This sequence is generated from feature [CDS]: 1..1608 placed under sequence number 107" /organism="Aetherobacter"

SEQ ID NO: 109 - protein, 535 aa, Aetherobacter; identical to SEQ ID NO: 98
  DOMAIN 1..535: "domain I"
  SOURCE 1..535: /mol_type="protein" /organism="Aetherobacter"

SEQ ID NO: 110 - DNA, 3498 bp, Aetherobacter
  source 1..3498: /mol_type="DNA" /organism="Aetherobacter"
  CDS 1..3498: /codon_start=1 /gene="domain IIa" /transl_table=11
atgactcaggttccggtcgccatcgtcggcgtgggcgcgctctttccgggctcgcccgacggtgcaggcttctggcgcgacatcgtcgcgtcacgcgatctcgtctccgacgtccccccggggcactggctgatcgaggactactacgatcccgatccctcggcgccggacaagacctactccaagcgcggggccttcctcggcgagacggccttcgatccgctggagttcggcgtggtgccgagctcgctcccgaccaccgacaccgcgcagctgctggcgctgatcgtggcgcggcgggtgctcgacgacgcgacccaggggcgcttcgcttccatcgatcggtcgcgcatcggcgtcgtcctcggcgtgacctcggggcaagagctcctcggcacgatggtgagccggctccagcggccggtgtggctcaaggcgctgcgcgacgacggcgtgcccgaggccgacgcgcagcggatctgcgatcgcatcaccaacgagtacgtgccctggaaggagtcgacgttccccgggctcctcggcaacgtggtcgccgggcgcatcgccaaccgcttcgatctcggcggcaccaactgcgtcaccgacgcggcgtgcgcgagctcgctcgcggcgctctcgatcgccatgaacgagctggcgctcgggcagtcggatctcgtgatcaccggcggggtggacacgatgaacgacatcctgatgtacacctgcttcagcaagaccccggccctctcgaagtcgggcgactgccgccccttctccgacgccgccgacgggacgctgctgggcgagggcctggcgatgttcgcgctcaagcgcctcaccgacgccgagcgcgacggggatcgcgtctacgcggtgatccgcggcctgggatcctcgtcggacgggcggagcaagagcgtgtacgcgccggtgccggaagggcaggccaaggcgctggtgcgggcctacgaggcggccggctacggcgcggacacggtggagctggtcgaggcgcacggcaccgcgaccaaggcgggcgacgcggcggagttcggcggcctcaagctggcgttcgaggcgagcgggcgcgcggatcaccagtggtgcgcgctcggatcggtcaaatcgcagatcgggcacaccaagtcggcggccggcgcggcgggcctcttcaaggcggtgatggcgctgcaccacaaggtcctgccgccgacgatcaaggtcgatcgccccaaccccgaattggcgatcgaggcgagcccgttctacctcaacacgcaggcgcggccctgggtgcgcaacgcgcagcacctgcggcgggcgtcggtctcgagcttcggcttcggcgggagcaacttccacgtgacgctggaggagtacgccggagcggcggagccggcggcgcgcctgcgcacggcgccgacggagctcttcgtgatctcggcgccctcggcggcggaggtcctcgcgcgcggcggcaagctcgccgagctcgcggacaaggagggcgcgacgacggcggcgcggacctcgcagcgcgacttcgtgacggcggatcacgcgcggctctcgatcgtggcgagcgacgccgcggatctgcgcgccaagctcgatcaggcgcgctcgctcctcggggcgcgccccgaggaggcgttctcgacgccgaccggcgtccacttcgcggtgggcgcggcggcgggcgacgtggcgttcctcttccccgggcagggcagccagtacgtgggcatgggcgccgacgtggccatggagcacaacgtcgcgctcgacgcgtgggacgcggcggcgggcctgatcgagaccgcggggctgcgcgacgtggtcttcccgcgcccggccttcaccgacgaggcgcgggcagagcaggcgcagctcctgacggcgaccgagtgggcgcagccggcgatcgccacggcgagcctcgcgctcctcgcggtgctgcgcgcggtcggcgtccgcccgtcgagcgtcgccggtcacagcctgggcgagctcaccgcgctcgccgcggccgatgctttgagcaccaacgatctcgtggccacggcgcgcaagcgcggccagctcatgaacgcggcctcgagcacgccgggggcgatgaccgcggtggcgcggcccctcgccgaggtgcaggccatcctcgcgcgcctccagagcgaggtggtggtggccaaccacaaccacccgacccaggtcgtcctcgccggcgagaccgccgcgatcgaggcggtcgaggccgagctcgcgcgccaggggatcaccgccaagcggctcccggtcgccacggcgttccacagccaggtcgtggccggggcgacggcgcccttcgccgagcacctcgccgggatcgcggtgaaggcgccggccatcgacgtgctctccaacagcgaggccgcggcgtacccgtcgtatcccgacgcggtgcgcgcgctcctcgccgggcagatcacgcgctcggtccgcttcgtcgaggtggtcgaggcgatgtgggcgcgcggggcgcgcatcttcgtggaggtcggcccctcggcggtgctgaccgagctctgcgcgcgcatcctcggcgagcggccgcacctggcgatcgccatggatcgcaagggcaagcacggcgtgaccgcgctccaggacgcgctcgggcgcctcgccgcggccggcgtggccatcgacttcgccccgctgtgggcgccgttcgggccgcccgcggcgccgaagcgggtcccggcgatgtcgatgatgatcaacggcgcgaactacgggaaggtctacccgcccaagggcggcgccgcggcgctgccgccgccgaacccgccgcggccggtcgttgctgctgcaacgatcgccgcggcgccgagctcggcggccaaggctccgatcgttgctgctgcaacgatcgccgcggcgccgagcccggcggcgaaggctccggtcgttgctgctgcaacgatcgcggcgcgccccgcggcggcgctcgagtcgcggccggtcgtcgcggctgcccctgctcctgctccggttgcggtggcgcccgcgtcgatggcggcggcgctgtcggcgccgggtcagctcggctggatcgaggcgtaccaggagtcgcagcggcagctcaccgacgcgcacgcgtcgtacgtgcggacgatggcgtcggggcacgaggcgttcctcacgacaatggaggcctcgttcatcggcctcggcggcctgctcggcgcgccggcttcggtgtccgcggtcgccccgcggagcacggcggctccgctgatcgcgcagcctgtcgcggtcgctccggcctcggtgatcgcgccggctccggtgcccgcgcccgctccggtgctcgctccggctccggctccggctccggctccggtgctcgcgcctgcgcctgtcgccgcggtagcgaaggcggctcccgcgccggtgatcgcgcccgcggcgccgtcgatcgatctccaggcgctgctgctcgacgtggtcgcg

SEQ ID NO: 111 - protein, 1166 aa, Aetherobacter
  SOURCE 1..1166: /mol_type="protein" /note="This sequence is generated from feature [CDS]: 1..3498 placed under sequence number 110" /organism="Aetherobacter"
MTQVPVAIVGVGALFPGSPDGAGFWRDIVASRDLVSDVPPGHWLIEDYYDPDPSAPDKTYSKRGAFLGETAFDPLEFGVVPSSLPTTDTAQLLALIVARRVLDDATQGRFASIDRSRIGVVLGVTSGQELLGTMVSRLQRPVWLKALRDDGVPEADAQRICDRITNEYVPWKESTFPGLLGNVVAGRIANRFDLGGTNCVTDAACASSLAALSIAMNELALGQSDLVITGGVDTMNDILMYTCFSKTPALSKSGDCRPFSDAADGTLLGEGLAMFALKRLTDAERDGDRVYAVIRGLGSSSDGRSKSVYAPVPEGQAKALVRAYEAAGYGADTVELVEAHGTATKAGDAAEFGGLKLAFEASGRADHQWCALGSVKSQIGHTKSAAGAAGLFKAVMALHHKVLPPTIKVDRPNPELAIEASPFYLNTQARPWVRNAQHLRRASVSSFGFGGSNFHVTLEEYAGAAEPAARLRTAPTELFVISAPSAAEVLARGGKLAELADKEGATTAARTSQRDFVTADHARLSIVASDAADLRAKLDQARSLLGARPEEAFSTPTGVHFAVGAAAGDVAFLFPGQGSQYVGMGADVAMEHNVALDAWDAAAGLIETAGLRDVVFPRPAFTDEARAEQAQLLTATEWAQPAIATASLALLAVLRAVGVRPSSVAGHSLGELTALAAADALSTNDLVATARKRGQLMNAASSTPGAMTAVARPLAEVQAILARLQSEVVVANHNHPTQVVLAGETAAIEAVEAELARQGITAKRLPVATAFHSQVVAGATAPFAEHLAGIAVKAPAIDVLSNSEAAAYPSYPDAVRALLAGQITRSVRFVEVVEAMWARGARIFVEVGPSAVLTELCARILGERPHLAIAMDRKGKHGVTALQDALGRLAAAGVAIDFAPLWAPFGPPAAPKRVPAMSMMINGANYGKVYPPKGGAAALPPPNPPRPVVAAATIAAAPSSAAKAPIVAAATIAAAPSPAAKAPVVAAATIAARPAAALESRPVVAAAPAPAPVAVAPASMAAALSAPGQLGWIEAYQESQRQLTDAHASYVRTMASGHEAFLTTMEASFIGLGGLLGAPASVSAVAPRSTAAPLIAQPVAVAPASVIAPAPVPAPAPVLAPAPAPAPAPVLAPAPVAAVAKAAPAPVIAPAAPSIDLQALLLDVVA

SEQ ID NO: 112 - protein, 1166 aa, Aetherobacter; identical to SEQ ID NO: 111
  DOMAIN 1..1166: "domain IIa"
  SOURCE 1..1166: /mol_type="protein" /organism="Aetherobacter"

SEQ ID NO: 113 - DNA, 798 bp, Aetherobacter
  source 1..798: /mol_type="DNA" /organism="Aetherobacter"
  CDS 1..798: /codon_start=1 /gene="domain IIb" /transl_table=11
gacaagaccggctaccccgccgagatgctcggcatgcacatggagctcgaggccgatctcggcatcgactccatcaagcgcgtcgagatcctctccgccatgcgcaagcgcgcgcccaaccttccggaggtcgtcgcctccgagatggccacgctccgtaccctcggacagatcgtcgagtacatgcgcgagcgatccggcgcgctgacggcgacgacgcacgagacgctggtccccgcgaccgcggaggctgcgacccaggcggctccggcgctcggcgatctccaggcgctgctgctcgacgtggtcgcggacaagaccggctaccccgccgagatgctcggcatgcacatggagctcgaggctgatctcggcatcgactccatcaagcgtgtcgagatcctctctgccatgcgcaagcgcgcgcccaacctccccgaggtcgtcgcctccgagatggccacgctccgcaccctcggacagatcgtcgagtacatgcgcgaccgctccggcgcgacggcggctccggtgaaagcagcgcccgcgcctgcgccggcgcctgcggcggctccgacgaaggaggcaccgacgctggcggatctgcaagcgctgctcctcagcgtcgtcgcggacaagaccggctaccccgccgagatgctcggtatgcacatggagctcgaggctgatctcggcatcgactccatcaagcgtgtcgagatcctctctgccatgcgcaagcgcgcgcccaacctccccgaggtcgtcgcctccgagatggccacgcttcgcaccctcgga

SEQ ID NO: 114 - protein, 266 aa, Aetherobacter
  SOURCE 1..266: /mol_type="protein" /note="This sequence is generated from feature [CDS]: 1..798 placed under sequence number 113" /organism="Aetherobacter"
DKTGYPAEMLGMHMELEADLGIDSIKRVEILSAMRKRAPNLPEVVASEMATLRTLGQIVEYMRERSGALTATTHETLVPATAEAATQAAPALGDLQALLLDVVADKTGYPAEMLGMHMELEADLGIDSIKRVEILSAMRKRAPNLPEVVASEMATLRTLGQIVEYMRDRSGATAAPVKAAPAPAPAPAAAPTKEAPTLADLQALLLSVVADKTGYPAEMLGMHMELEADLGIDSIKRVEILSAMRKRAPNLPEVVASEMATLRTLG

SEQ ID NO: 115 - protein, 266 aa, Aetherobacter; identical to SEQ ID NO: 114
  DOMAIN 1..266
  SOURCE 1..266: /mol_type="protein" /organism="Aetherobacter"

SEQ ID NO: 116 - DNA, 2403 bp, Aetherobacter
  source 1..2403: /mol_type="DNA" /organism="Aetherobacter"
  CDS 1..2403: /codon_start=1 /gene="domain IIc" /transl_table=11
cagatcgtcgagtacatgcgcgaccgctccggcgggcacaacgtggcggccacgacgccggcgccggctccggctccggccaccgccacgactcccgctccggtggcgagcgcggcgccgagccgcatcggccgctacgtggtgggcacgcgcgaggaggcggcgagcgggctggcgatgggcggcgtgctcggcgcgcggcgcgtcgtcatcaccaacgaagggacgggcatcgcgcaggcgctggtgcgggcgctgcaagagcgcggcgtcagcagcgaggtcgtgaccgaggtgccggcggacgccgacgcggtggtgttcctcggcgggctgcggaccctcgtcgacgtcgacacggccatcgccatcaaccgcgaggccttcctcgcggcgcgcgcggtggccggcgtgttctcgcgcaacggtggcgccttcgtgacggtccaggacacgggcggcgatctcgggatcgaggcgcgcgagccgcgggcggcgtggctcgcgggcgtggccgcgctggcgcggacggcgcagctcgagtggccgaaggcctcggtgaaggccgtcgacgtcgagcgcggcgggcgcagctccgaggagatcgccgcggcgatcgccgaggagatcctcaccggcggcggcgcgctcgaggtcggcctgacggcggccggcgcgcggcgcgtgcccgaggtcgtgcagcgcgcggtgggcgagcggaccccggtcctcgctcgcagctcggtcgtcgtcgcctccggcggggcgcgcggcgtcaccgccacggcgctgatcgcgctggcgcgccacgcgcagccgaagctggtgatcctcgggcgatccgcgctcgaggcggagcccgcggcgtgcgtcggcgtgcgcggcgacgcggcgctcaagcgcgccttgctcgaggacgcgcgcgcgcagggccggacggcgaccatcgccgagatcggcgcccacgtggcgcgcatctccgcgagccgcgaggtgctggagacgctcgcggcgatcaaggccgcgggcggcgaggcgcgctacctcgccgtcgacgtcaccgacgccgatcgcctccgcgtcgcgctcgaggaggtccggcgcgactggggcccgatcaccgtcgtcgtccacggcgccggcgtcctcgccgacaagcggatcgaggacaaaacgcccgagcagttcgatcgggtcttcgataccaaggtcctcgggctgcgcgcgctcctcgccgcgaccgagggcgatccgctgcgcgcgatcatcctcttctcttcggtcgccgcgcgcgcgggcaacgtcggccagtgcgactacgccatggccaacgagatcctcaacaaggtggccatcaccgagcggcggcggcgcggcggcgcgtgcaccgtcaagtcgatcggctggggcccctgggagggcgggatggtgacgcccgcgctcaaggggcacttcgaatcgatgggcgtggcgctgatcccgctcgccgagggcgccgagcacttcatcgccgagatcgagggctccgccgaggagatcgagctggtgatcggtggcggcgccgacggcagcgccatccgcggcgacgccgagccgacgatccacttcggggtctcggtctcggatcgcacgagcccatggctcgccgatcaccgcgtcgcggggcgccgcgtcatccctgtcgccgtggtgatcgagtggttcactcgcgcggtcacggcgctccagggccgcgctgcggtgagcctccgcgacgtcaaggtgctgcgcgggatcaagctccccgccggggacgccgcggcctcgttcacgatcggctgccgcaagctcaccgatggaaagatcgagctcacgctccacggggccgacggcgccctgcactaccgcgcgagcgccgagcccagaggcgcagcgctgaagcccgagggcgccgcgcttccgctcgcggcgtggggcgatcggccgatctacgacggcgggctgctcttccacgggccgcgcttccacgccatccacagcatcgagggcgcctcggccgaggggatccgcgccacgctcaccggcgcgcgcgagctcggctggccgggcgaagcgcagcgcaccgacccggcgatcgtcgacggcgcgctccagctcgcgctgctctggacgcgcgagcgcctcggtcaggcctcgctcccgatggccatcgcggccttcgactggcaggcctcggggccggtcgaaggtccagtgcgcgcggtcgttcgagggcgcgaggccgacagcgcccacgctatctgcgacgtgtggctcgaggacgcgcgcggcgtgatcctcggcgccctccacggcgtcgagaccatcgtgcggcccgccgaggtccgcgcgccgcacctcgtggagacagggccggcctcgtga

SEQ ID NO: 117 - protein, 800 aa, Aetherobacter
  SOURCE 1..800: /mol_type="protein" /note="This sequence is generated from feature [CDS]: 1..2403 placed under sequence number 116" /organism="Aetherobacter"
QIVEYMRDRSGGHNVAATTPAPAPAPATATTPAPVASAAPSRIGRYVVGTREEAASGLAMGGVLGARRVVITNEGTGIAQALVRALQERGVSSEVVTEVPADADAVVFLGGLRTLVDVDTAIAINREAFLAARAVAGVFSRNGGAFVTVQDTGGDLGIEAREPRAAWLAGVAALARTAQLEWPKASVKAVDVERGGRSSEEIAAAIAEEILTGGGALEVGLTAAGARRVPEVVQRAVGERTPVLARSSVVVASGGARGVTATALIALARHAQPKLVILGRSALEAEPAACVGVRGDAALKRALLEDARAQGRTATIAEIGAHVARISASREVLETLAAIKAAGGEARYLAVDVTDADRLRVALEEVRRDWGPITVVVHGAGVLADKRIEDKTPEQFDRVFDTKVLGLRALLAATEGDPLRAIILFSSVAARAGNVGQCDYAMANEILNKVAITERRRRGGACTVKSIGWGPWEGGMVTPALKGHFESMGVALIPLAEGAEHFIAEIEGSAEEIELVIGGGADGSAIRGDAEPTIHFGVSVSDRTSPWLADHRVAGRRVIPVAVVIEWFTRAVTALQGRAAVSLRDVKVLRGIKLPAGDAAASFTIGCRKLTDGKIELTLHGADGALHYRASAEPRGAALKPEGAALPLAAWGDRPIYDGGLLFHGPRFHAIHSIEGASAEGIRATLTGARELGWPGEAQRTDPAIVDGALQLALLWTRERLGQASLPMAIAAFDWQASGPVEGPVRAVVRGREADSAHAICDVWLEDARGVILGALHGVETIVRPAEVRAPHLVETGPAS

SEQ ID NO: 118 - protein, 800 aa, Aetherobacter; identical to SEQ ID NO: 117
  DOMAIN 1..800: "domain IIc"
  SOURCE 1..800: /mol_type="protein" /organism="Aetherobacter"

SEQ ID NO: 119 - DNA, 2607 bp, Aetherobacter
  source 1..2607: /mol_type="DNA" /organism="Aetherobacter"
  CDS 1..2607: /codon_start=1 /gene="domain IIIa" /transl_table=11
gtgaccttcgaaccgatcgcgatcgtcgggcaggcctgcacgctccccggcgcgctgacgccggaggcgctgtgggccaacgttctccgcggcgagagcgccgtgacctcgccgccggagggccgctggcgcctcccggcgtggcacgcgatggggaagccgggcgcgcaggaagagcgcgcctggtccgacgccggaggctatgtccgcggcttcgattcggtcttcgatcccggcggcctgcgcctcccggaggccgagctccgcggcctcgatccggtgttccagtggacgctccacaccgcgcgcgcggccctgcgatccgcggggatggaggggccgtcggcgcgcgccgggctcgtcctcggcaacctctcgttcccgacggcgtcgatgtcgcgctacgccgagagcgtctggctcgaggcgctgggcaaggagctcctcggcgggcgcgcggcggcgcaggccggcgtcacccaccccgacgcgcacaaccgcttcatgtccgggctccccgcgcacctcgccgcgcaggccctcgggctcggcgggggcgccttcgcgctcgacgccgcctgcgcctcgtcgctctacgcgatcaagctcgcctgcgaccggctccaggatcgcgctgccgatctgatgctggccggcgccgtcaacgccgccgacagcctcttcctccacatcgggttctcggccctctcggcgatgagccgcaccggccagtcgcgcccgtttcaccgcgaggccgacggcctcgtcccctcggagggagccgtcttcttcgcgctccagcgcctcgacgacgcgcgcgccgccggccgccgcgtcctcgggatcatccgcggcatcggcctctccaacgacgggcgcggccgcggcctcctcgcgccctcggaggagggacagatccgcgccatgcgcctggcctacgccgcggcggggctcacgccctccgacgtgagcttcgtcgagtgccacgccaccggcacgcccgtcggtgacgccaccgagatccggagcctcagcgacgtcttcgccgggtgccgcgacgtgcccatcggctcgctcaagtccaacctcggccacctcatcaccgccgcgggcggcgccggcctgatcaaggtcctcggatcgttcaccgccgaaaccatcgcgccgacgatccacgctggggcttcgatccccgagctcgccgggtcgccggtccgcctcgtcacgcaggccgagccctggcgcgcggcgggccgccgcatcgccgcgatcagcgccttcgggttcggcggcaacaacgcccacctgatcgtcgagcaggacgacggccgcgccacagcgacgcgggccacagcgacgcgatccgcgccggcgccgatcgccgtcgtcagcctcggcgccaggatcggcgagaccaccggccgcgacgaggccgcgcgcgcgctgctctccggcgcgggctggggcagccgccgcgaggcggtcacggtcgagctcgaggggctgcgcttcccgccgcgcgatctcgagcagacgctcccgcagcagctcctcgtcctcgaagcggggcgcgaggcgatccgcgggctctcgctcccgcgcgatcgcaccgccgtgctcatcggcatgggcgccgatcccgaggtcgcgcgctacggcgctcgctggcgcctgcccgcgttcgccgacgcctgggcgacggccgggctccccgtgtcgagcgcctggaccgaggccgcgcgcgacgccgtgcaagagcagcacggcgcggccggcgtcgtcggcgccatgcccaacatccccgccaaccgcctcagcagccagctcgatctcgccgggccgagcttcaccatctcctcggaggagctctccggcgtcgtcgccttgcagctcgccgcgcgcgcgctgcgcagcggcgagatcgacgcggccctcgtcggcgccgtcgatctcgccgatcagatcgtccaccgccaggcgctgggcgagctcggcctcgagccccgcgccggcgacgccgcggtggcgctcgtgctcaagcgcctcaccgacgtgcgcaagagcgagaaggtcctggcgatcctcgacgagggcatcgtggacgcgtccagcgatcccgcgcgcctccgcgtcggcgacggcggcgccgatctcgatcccttcgcggccacgggcaagccgcacgcggcggcgggcctcgtccacgtcgccgccgccgtgctcgcgctgcaccacggcgcgcgccccgcccccgggcgcgcctccatgccctgggtcggcccccgccacgccgaggtgacgacgcaggccctcggcgatcaggcggcgacgatccacctccgcggcggcggccccgccgcgccgctgctgctcgacgccacgccgcagatccacgtcttcgccagcgccgatcgcgaggccgtgctccgcgccctcgccgacgggcgcgagggcctcgacggccccgcgcgcgcggtgatcgtggccggctcgcgcgaggagctcgaggcgcgccgcgccgacgccctccgcgccgccgagcgcaacgcccccatgcccgacggcgtcttcctccgcgatcgccccgtcgtcggcgagctcgccttc

SEQ ID NO: 120 - protein, 869 aa, Aetherobacter
  SOURCE 1..869: /mol_type="protein" /note="This sequence is generated from feature [CDS]: 1..2607 placed under sequence number 119" /organism="Aetherobacter"
VTFEPIAIVGQACTLPGALTPEALWANVLRGESAVTSPPEGRWRLPAWHAMGKPGAQEERAWSDAGGYVRGFDSVFDPGGLRLPEAELRGLDPVFQWTLHTARAALRSAGMEGPSARAGLVLGNLSFPTASMSRYAESVWLEALGKELLGGRAAAQAGVTHPDAHNRFMSGLPAHLAAQALGLGGGAFALDAACASSLYAIKLACDRLQDRAADLMLAGAVNAADSLFLHIGFSALSAMSRTGQSRPFHREADGLVPSEGAVFFALQRLDDARAAGRRVLGIIRGIGLSNDGRGRGLLAPSEEGQIRAMRLAYAAAGLTPSDVSFVECHATGTPVGDATEIRSLSDVFAGCRDVPIGSLKSNLGHLITAAGGAGLIKVLGSFTAETIAPTIHAGASIPELAGSPVRLVTQAEPWRAAGRRIAAISAFGFGGNNAHLIVEQDDGRATATRATATRSAPAPIAVVSLGARIGETTGRDEAARALLSGAGWGSRREAVTVELEGLRFPPRDLEQTLPQQLLVLEAGREAIRGLSLPRDRTAVLIGMGADPEVARYGARWRLPAFADAWATAGLPVSSAWTEAARDAVQEQHGAAGVVGAMPNIPANRLSSQLDLAGPSFTISSEELSGVVALQLAARALRSGEIDAALVGAVDLADQIVHRQALGELGLEPRAGDAAVALVLKRLTDVRKSEKVLAILDEGIVDASSDPARLRVGDGGADLDPFAATGKPHAAAGLVHVAAAVLALHHGARPAPGRASMPWVGPRHAEVTTQALGDQAATIHLRGGGPAAPLLLDATPQIHVFASADREAVLRALADGREGLDGPARAVIVAGSREELEARRADALRAAERNAPMPDGVFLRDRPVVGELAF

SEQ ID NO: 121 - protein, 869 aa, Aetherobacter; identical to SEQ ID NO: 120
  DOMAIN 1..869: "domain IIIa"
  SOURCE 1..869: /mol_type="protein" /organism="Aetherobacter"

SEQ ID NO: 122 - DNA, 3264 bp, Aetherobacter
  source 1..3264: /mol_type="DNA" /organism="Aetherobacter"
  CDS 1..3264: /codon_start=1 /gene="domain IIIb" /transl_table=11
cagcagccggtccgccagctcgtgagcgcggtcgcccagctcatcgccgccggcgtgcccgtcgccgccgacgccctcctcgccaggctcgcgccgcctcccccggcgcgctcctcgggccccacgctcaccgtgcgcgctcaccctcctgacattcacttcccgacggcccctgccatgcaactgatgccgcccgcgccccttctcccgccggtgctcgccgacaaccccgcgccgcgcacggagcggagcttcaccgggagggcggccatgcgagaggacgcgcccgacggcttcccgtcccctcgcctccccgtgttcgcgaggctcgcgccggtgttcacccacgccgagccggtgttcacgcacgtcgagcccgcgctcgcgagccacgagccggcggtcacgcccgccgagccggcggtcacgcctgccgagccggcggtcacgcacgccgagcctccgctcacgagccccgtggatggccagcacgcctccatcgccgcgcgcggcgctgccgtcagcgcggggatcgccgccgcgcaccgcgcttacgtcgaggcgcaaggcgccgtgcacgcccgcttcctcgcgctctcgggctccttgctctcgcgcctcgccgccgccccgaccgccgccgccttcccggcgcctgctccctcgcccgcgccgacagccgccctcccggcgcctgctccctcgctcccgccgcagcgcctcaccgcccccaccctcgtggtcgctcggccggtcgccccgcccgccccggcgcccgagcgcgccgccgtggccgcgttcgcccccgcgccgatctcggctccggcctccacgctgcccgcgccgtccctgctccgctccacgctccccgggcccaagttctcgcgcgcggatctcgaggtcctggcctccggctcgatctcctcgatcttcggcccccagttcgccggccaggatggctatgccaagcaatgtcggatgccggagcccccgctcctgctcgccgatcgcgtaactggcatcgacgctgtcccgggctcgatggacacaggcaccatctggaccgagaccgacgtcaagcacgacagctggtatctccaccagggccggatgccgacaggcatcgtgatcgagtccggccaggcggatctcctcctgatctcctggctcggtatcgacgccctcaacaagggtgagcgggtctatcgcctcctcggctgcgaggccacctatcacggcgagctcccgaagccgggcgacacgctcgtctacgagatccacatcgacggccacgccgagcagggcgacgtgcggctgttcttcttccactacgactgccgcatcaacggcgagctgcggatctcggtgcgcaacggccaggccgggttcttcacctatcaagagctcgccaactccggcggcgtgctctgggacgccgacggcgcgccgcacgaggcgacagggcccctcgatccgccgcaggtggtctgcgagaagcagtcgttcacctcggccgaggtcctcgccttctccgagggggacgcctacgcctgcttcgggcgcggcttcgagcgcgctcagacgcacgtgcgcaccccgcgcatccaggacgggccgatgcggctcctcgatcgcgtcacccacttcgatcctcgcggcgggccctggggtcgcggctacctgcgcgccgaggccaagctctcgcccgacgactggttcttgcgcgggcacttcaagaacgatccctgcatgccagggacgctgatcctcgaggcctgcgtgcaggccatggccttctatctctgcgccatgggctactccatcgatcgcgacggctggcgcttcgagcccgtccccggccagaagagcccgatgcgctgccgcggccaggccagcgtgacctcgcgggagatcgtctacgagatcttcgtccacgaggtcacgagcgggcctatccccagcgtcaaggtcgacatgctctgcaccgtcgacggcctcaaggccttccacggcgagcgcgtcggcctgcgcctcgtccccgcctggcccctcgacgactggcgacaggcccccgtcgccccgcagagcctgcaccgccgcgccaaggagatcgctcctctcggcgggatccgcggccacgtcgagaccaggccggtgccctcggtcaacggctttgccttcgactacgcctcgctcatcgcctgcgcctggggcaagccctcgcaggccttcgggccgatgtacgcgcccttcgacggcacccgccgcgtcgcccgcctgcccgggccgccttatcacttcatcacgcgcatcatctcggtcgagggcccgatcggcgtcccccagcccggcgccgaggtcgaggtcgagtacgacgtcccccacgacgcctggtatttcgcggagaacggcgcgcgcaccatgccgttctgtgtcctgctcgaggccgcgctccagccctgcggctggctggcgagctacatcggcagcgccctcaccaccgaggacgatctgctcttccgcaacctcgacgggactggcaccgtcctcgcggagatcacccccgagtccggcacgctgcgcacccacgtcaaggtggtcgaggtctcgcagtccgcggggatgatcatcgagaccttcgaagtcgagtgcttcgtcggcgaagcccacgtgtacacgctgcgcaccgtctttggcttcttccccaaatcggccttcgacaaccaggtcggcctccccgtctccgccgaggcccgcgcccggatcgagcgacaggccacctcgaccgtcgatctcgcctcggagccgccgcgctacttcggcggcgcccctcgcctccccgaagcgatgctgtgcatgctcgatcgcatcaccgcgttcgagccgaccggcggcctcaagggccttggctatggccgcgccgagaagacggtcaaacccggggagtggtccttcaaagcccacttcttccaggaccccgtccagcccggctcgctcggcctcgaggccatcctccagctcctccaggcgtggatgatcgacgccggcgacgccgagggcatccccggcgcgcgcttcgagcccatcgccgtcggccgcccgatgacctggaaataccgcggccaggtcgtccccaagaaccgcctcgtcacggtggagatcgacatcaccgagcgcggcaccgacgatcgcgggcgcttcgccctggccgagggctcgctctgggtcgacggcaagcgcatctacggcgcgaagaacctcggc

SEQ ID NO: 123 - protein, 1088 aa, Aetherobacter
  SOURCE 1..1088: /mol_type="protein" /note="This sequence is generated from feature [CDS]: 1..3264 placed under sequence number 122" /organism="Aetherobacter"
QQPVRQLVSAVAQLIAAGVPVAADALLARLAPPPPARSSGPTLTVRAHPPDIHFPTAPAMQLMPPAPLLPPVLADNPAPRTERSFTGRAAMREDAPDGFPSPRLPVFARLAPVFTHAEPVFTHVEPALASHEPAVTPAEPAVTPAEPAVTHAEPPLTSPVDGQHASIAARGAAVSAGIAAAHRAYVEAQGAVHARFLALSGSLLSRLAAAPTAAAFPAPAPSPAPTAALPAPAPSLPPQRLTAPTLVVARPVAPPAPAPERAAVAAFAPAPISAPASTLPAPSLLRSTLPGPKFSRADLEVLASGSISSIFGPQFAGQDGYAKQCRMPEPPLLLADRVTGIDAVPGSMDTGTIWTETDVKHDSWYLHQGRMPTGIVIESGQADLLLISWLGIDALNKGERVYRLLGCEATYHGELPKPGDTLVYEIHIDGHAEQGDVRLFFFHYDCRINGELRISVRNGQAGFFTYQELANSGGVLWDADGAPHEATGPLDPPQVVCEKQSFTSAEVLAFSEGDAYACFGRGFERAQTHVRTPRIQDGPMRLLDRVTHFDPRGGPWGRGYLRAEAKLSPDDWFLRGHFKNDPCMPGTLILEACVQAMAFYLCAMGYSIDRDGWRFEPVPGQKSPMRCRGQASVTSREIVYEIFVHEVTSGPIPSVKVDMLCTVDGLKAFHGERVGLRLVPAWPLDDWRQAPVAPQSLHRRAKEIAPLGGIRGHVETRPVPSVNGFAFDYASLIACAWGKPSQAFGPMYAPFDGTRRVARLPGPPYHFITRIISVEGPIGVPQPGAEVEVEYDVPHDAWYFAENGARTMPFCVLLEAALQPCGWLASYIGSALTTEDDLLFRNLDGTGTVLAEITPESGTLRTHVKVVEVSQSAGMIIETFEVECFVGEAHVYTLRTVFGFFPKSAFDNQVGLPVSAEARARIERQATSTVDLASEPPRYFGGAPRLPEAMLCMLDRITAFEPTGGLKGLGYGRAEKTVKPGEWSFKAHFFQDPVQPGSLGLEAILQLLQAWMIDAGDAEGIPGARFEPIAVGRPMTWKYRGQVVPKNRLVTVEIDITERGTDDRGRFALAEGSLWVDGKRIYGAKNLG

SEQ ID NO: 124 - protein, 1088 aa, Aetherobacter; identical to SEQ ID NO: 123
  DOMAIN 1..1088: "domain IIIb"
  SOURCE 1..1088: /mol_type="protein" /organism="Aetherobacter"

SEQ ID NO: 125 - DNA, 921 bp, Aetherobacter
  source 1..921: /mol_type="DNA" /organism="Aetherobacter"
  CDS 1..921: /codon_start=1 /gene="domain IV" /transl_table=11
gtcttcgcgggcgccgccgcggcgtacccgagcatgggccgcgccctcgcgctcgcgctccccgacgtgatggcgcgcctcgggaaccggctctcgacgctgcccgcggtgatcgactggatccacggcgcgccgcgcgagccgcgccacccgctcgagcagctctgggcgtcgtcgttcctctgccagctccacgccgagatcacgcgcgtcgacctcgggctccgccccagcgcgaccatcggctactcctccggcgagagcaacgcgctcttcgccatgggcgcctggcgcgacctcgacgccatgatgcacgaggcctggaccgagccgctcctgacctcggagctcgtcggcgactacgccgcggcgcgccgcctctgggcgcgctccggcgtcaccagccccgcggcgacctgggccgcgtgggtcatcgccgcgcccgtggacgacgtgcgccgcgccctcgcaggcgagccgctcgcgcacctcaccatcatcaacaccgccgaggagtgcgtgatcggcggcgagtcctccgcgtgcgagcgcgtcgtcgcgcggctcggcaagaacctcgcgctgccgctcagctacgccatggcctcgcactgccccgaggtcgccgaggcgcgcgatgcgtggatcaagatgcaccgccgcgccaccttcgacgtccccggcgtgcgcatctactccgccggcgccgagcaggccttcgcccccacggccgacgccgccgcgatggccatcaccggccaggcggtggacacgctcgatttcccccgcgtgatcgagcgcgcctacgccgacggcgtccgcgtcttcgtcgagcacggcccgcgcggcctctgcagccgctggatcgcgcgcatcctcggcgcgcgcgagcacctcgtcgtcccgctcgacgtcgccggg

SEQ ID NO: 126 - protein, 307 aa, Aetherobacter
  SOURCE 1..307: /mol_type="protein" /note="This sequence is generated from feature [CDS]: 1..921 placed under sequence number 125" /organism="Aetherobacter"
VFAGAAAAYPSMGRALALALPDVMARLGNRLSTLPAVIDWIHGAPREPRHPLEQLWASSFLCQLHAEITRVDLGLRPSATIGYSSGESNALFAMGAWRDLDAMMHEAWTEPLLTSELVGDYAAARRLWARSGVTSPAATWAAWVIAAPVDDVRRALAGEPLAHLTIINTAEECVIGGESSACERVVARLGKNLALPLSYAMASHCPEVAEARDAWIKMHRRATFDVPGVRIYSAGAEQAFAPTADAAAMAITGQAVDTLDFPRVIERAYADGVRVFVEHGPRGLCSRWIARILGAREHLVVPLDVAG

SEQ ID NO: 127 - protein, 307 aa, Aetherobacter; identical to SEQ ID NO: 126
  DOMAIN 1..307: "domain IV"
  SOURCE 1..307: /mol_type="protein" /organism="Aetherobacter"

SEQ ID NO: 128 - DNA, 1113 bp, Aetherobacter
  source 1..1113: /mol_type="DNA" /organism="Aetherobacter"
  CDS 1..1113: /codon_start=1 /gene="domain IV*" /transl_table=11
atgcgcgtcgtcgccggccccgagcgcccgccgcccggctcgccgccttcgcccgcttcgccgaccgcgccgactgcgcccccttcgccgcctgccccgacggtgccggctgcgctggctgcgccgccttcgcgcgatctcgcctcgtttcgcagcttctggcgcgcctcgatcggggtcgggccctggccgatcgaggatctctacatcgcgctggtggagcgcttcctcggccggatcgtcatcgccgatccggtcgccttctcgcgcgtccacggccgcggctgcctcttcgtcgccaaccaccaggtcgcgctggagtcgctgatcttcatcatggtcgcctcggcgatctccggcacgaggacgatggcgctcgccaaggccgagcatcaagagtcgtggctcgggcgcctgatcacccggggcatcgcctaccccggcgtcaccgatccaggcctgatcaccttcttcgatcgcgaggatcacgcctccttcgcccgcatcgccgagcaggccacgcgcgatctcgcggcctcgaccaagagcgtgctcgtccacgtcgagggcacgcgcgccatctcgtgccgcacccccgtcacccgcctcggcgcctcggtgatcgacatggcgctcgccgccggcgcgcccatcgtcccggtccgcttcgcccgcggcctgcccgagagcgacgcccccgagcgcctcgatttccccctcggctacggccgccaggacatccacttcggcgccccgatcgagcccgccgatctcgcgcgcctcccgctcaaggaccgcaaggacgccttgctcgccgccctcaacacgctcggccccggctcgagcgacacgccctccgaccccgacccgagcttcgccgcccaggtcgaggcctggcgatcccgcaccggctgcgcgctcgaagatgccgtgttctatgccaccctcgccggagcgtcagccccggagtcggagggcgtgcagcggttactggagggggcgaggacggggaagctggctatcgggggcgaggcgaaggatcgctggctgggcgagtttgcgcggagcctgtttggatcggcggatgcgacgctcgtggtgcaggatggctga

SEQ ID NO: 129 - protein, 370 aa, Aetherobacter
  SOURCE 1..370: /mol_type="protein" /note="This sequence is generated from feature [CDS]: 1..1113 placed under sequence number 128" /organism="Aetherobacter"
MRVVAGPERPPPGSPPSPASPTAPTAPPSPPAPTVPAALAAPPSRDLASFRSFWRASIGVGPWPIEDLYIALVERFLGRIVIADPVAFSRVHGRGCLFVANHQVALESLIFIMVASAISGTRTMALAKAEHQESWLGRLITRGIAYPGVTDPGLITFFDREDHASFARIAEQATRDLAASTKSVLVHVEGTRAISCRTPVTRLGASVIDMALAAGAPIVPVRFARGLPESDAPERLDFPLGYGRQDIHFGAPIEPADLARLPLKDRKDALLAALNTLGPGSSDTPSDPDPSFAAQVEAWRSRTGCALEDAVFYATLAGASAPESEGVQRLLEGARTGKLAIGGEAKDRWLGEFARSLFGSADATLVVQDG

SEQ ID NO: 130 - protein, 370 aa, Aetherobacter; identical to SEQ ID NO: 129
  DOMAIN 1..370: "domain IV*"
  SOURCE 1..370: /mol_type="protein" /organism="Aetherobacter"

SEQ ID NO: 131 - DNA, 1608 bp, Aetherobacter rufus
  source 1..1608: /mol_type="DNA" /organism="Aetherobacter rufus"
  CDS 1..1608: /codon_start=1 /product="domain I" /transl_table=11
gtgcctgcaatcggtagatggaacgctcaagggggctcgcccgagctgaccccttcggcgatggtcgcagcgatagcgcgttgtcgagagccggtgcacgtggtgcgcgacggagagtccgggccgatcggcctgggcgtggggggcgagctgctccctccgggcgagcggcgagcaggcgagtacacgctcgtcgcctcgttgccgccgctctttcccgagtggctcggcgatcgctcgttctgcgaggtccacggggtccgcttcccctatgtcgccggagagatggccaacggcattgccacggtggaaatggtcgtcgccatgagccggagcggaatgctcggcttcttcggcgccgccggcctgggcttctcccgggtcgaggccgccgtgcagacgctccgcgccacgctgggcgacgaggcgccgtggggggtgaacctcattcattcaccgaacgaagcctcgctggagaatcgcgtcgcggatctcctgatcgagagcggggtgcggcgcatctcggtgtcggccttcatggcgctgacgccggccgtcgttcgctgcgcggcgcgcgggctcaccctcgacgcggcggggcggatcgtgcggccgcggcacatcttcgccaagctctcgcgccgcgaggtggcgctgccgttcctctcgcccgcgcctgaggagatcctgcgggccctcgtcgccggcggcgggctgaccgaggaagaggcgcggctcgccgcgcaaatcccaataaccaaggacatcaccgtcgaggccgactccggcggtcacaccgacaatcaagcgctggtggcgttgctcccgacgatcttccagctccgcgacgagctcgcggagaaacacaaatatacgcggccgatccgcgtcggcacggccaacggactgggcacgcccagcgcggtcgccgcggccttctcgctcggggcggcctacgtggtcaccggctcggtgaaccaggcggcgctggagtcggggctctcggacgagggcaagcgcatgctggcccaggccgaggtcgcggacgtgatcatggcgcccgcggccgacatgttcgagctcggggtcaagctccaggtgctgcggcgcgggagcatgttcggcgtgcgcgcggccaagctctacgaggcttacgtcgcgcacccctcgctcgaagcgatccccgatgccctccgcgcgcggctcgagcgcgaggtcttgcacacgacgttcgccgcgatctgggaggagacgcgggcgttctgggaggcgcgcgatcccgagcaggtcgcgctcgcggcgcgggatcccaagcaccggatggcgctggtcttccgctggtatctcggcatggcgagccgctgggccatcgccggcgaggcgtcgcggagggccgactaccagatctggtgcgggcccgcgatgggggccttcaactcctgggttcgtggctcgttcctcgaagatccccggcagcgcggcgtggtgccgatcgcgctgaacctgctcgaaggcgcggcggtcgtcacccgcgctcaccagctccgcacctacggcgtgcccgtgccggccgccgcgttcgacttccgacctcgtccgctcgcttga

SEQ ID NO: 132 - protein, 535 aa, Aetherobacter rufus
  SOURCE 1..535: /mol_type="protein" /note="This sequence is generated from feature [CDS]: 1..1608 placed under sequence number 131" /organism="Aetherobacter rufus"
VPAIGRWNAQGGSPELTPSAMVAAIARCREPVHVVRDGESGPIGLGVGGELLPPGERRAGEYTLVASLPPLFPEWLGDRSFCEVHGVRFPYVAGEMANGIATVEMVVAMSRSGMLGFFGAAGLGFSRVEAAVQTLRATLGDEAPWGVNLIHSPNEASLENRVADLLIESGVRRISVSAFMALTPAVVRCAARGLTLDAAGRIVRPRHIFAKLSRREVALPFLSPAPEEILRALVAGGGLTEEEARLAAQIPITKDITVEADSGGHTDNQALVALLPTIFQLRDELAEKHKYTRPIRVGTANGLGTPSAVAAAFSLGAAYVVTGSVNQAALESGLSDEGKRMLAQAEVADVIMAPAADMFELGVKLQVLRRGSMFGVRAAKLYEAYVAHPSLEAIPDALRARLEREVLHTTFAAIWEETRAFWEARDPEQVALAARDPKHRMALVFRWYLGMASRWAIAGEASRRADYQIWCGPAMGAFNSWVRGSFLEDPRQRGVVPIALNLLEGAAVVTRAHQLRTYGVPVPAAAFDFRPRPLA

SEQ ID NO: 133 - protein, 535 aa, Aetherobacter rufus; identical to SEQ ID NO: 132
  DOMAIN 1..535: "domain I"
  SOURCE 1..535: /mol_type="protein" /organism="Aetherobacter rufus"

SEQ ID NO: 134 - DNA, 1077 bp, Aetherobacter rufus
  source 1..1077: /mol_type="DNA" /organism="Aetherobacter rufus"
  CDS 1..1077: /codon_start=1 /gene="domain IV*" /transl_table=11
atgcgcgtcgtcgccggccccgagctcccgccgcccgccctgcccccttcacgcgatccgagccccgagcggggcgacggcgaggcgggcttccagcgcgatctcgcctcgtttcgcggcttctggcgcgcctcgatcggcgtcggcccctggccgatcgaggatctctacatcgccctggtcgagcgcttcctcggccggatcgtgatcgccgatccgatcgccttctcccgcgtccacggccgcggctgcctctacgtcgccaaccatcaggtcgcgctggagtcgctgatcttcatcatggtcgcctcggcgatctcgggcacgaggacgatggcgctcgccaaggccgagcaccaggagtcgtggctcgggcgcttgatcacccgcggcgtcgcctaccccggcgtcaccgatcccggcctgatcaccttcttcgatcgcgaggatcacgcctcgttcgcgcgcatcgccgagcaggccacggccgatctcgcggcctcgaagaagagcgtgctcgtccacgtcgagggcacgcgcgcgctctcttgccgcgcgcccgtcacccgcctcggcgcctcggtgatcgacatggcgctcgccgccggcacgctcatcgtcccggtccgcttcgcgcgcggcctgcccgaaagcgacgcggccgagcggctcgatttcccgatcggcttcggccgccaggacatccacttcggcgcgccgatcgagcccgccgatctcgcgcgcctcccgctcaaggaccgcaaggacgccgtgctcgcggccctcaacacgctcgggcccggcgcaggcgacacgccctcggagccggactcgagcttcgccgcgcagatcgaggcctggcgagcccgcaccggctgcgcgctcgaggacgcggtcttctacgccaccctcgccggcgcatcagcgcccgaatcggagggcgtgcgccgcctcctcgaaggcgcgcgaacaggcaagctcgtcgtcggcgacgacgcgaaggatcgctggctcggcgacttcgcccgctccctcttcggctctgcggatccgacgctccagatccagcgcgggtga

SEQ ID NO: 135 - protein, 358 aa, Aetherobacter rufus
  SOURCE 1..358: /mol_type="protein" /note="This sequence is generated from feature [CDS]: 1..1077 placed under sequence number 134" /organism="Aetherobacter rufus"
MRVVAGPELPPPALPPSRDPSPERGDGEAGFQRDLASFRGFWRASIGVGPWPIEDLYIALVERFLGRIVIADPIAFSRVHGRGCLYVANHQVALESLIFIMVASAISGTRTMALAKAEHQESWLGRLITRGVAYPGVTDPGLITFFDREDHASFARIAEQATADLAASKKSVLVHVEGTRALSCRAPVTRLGASVIDMALAAGTLIVPVRFARGLPESDAAERLDFPIGFGRQDIHFGAPIEPADLARLPLKDRKDAVLAALNTLGPGAGDTPSEPDSSFAAQIEAWRARTGCALEDAVFYATLAGASAPESEGVRRLLEGARTGKLVVGDDAKDRWLGDFARSLFGSADPTLQIQRG

SEQ ID NO: 136 - protein, 358 aa, Aetherobacter rufus; identical to SEQ ID NO: 135
  DOMAIN 1..358: "domain IV*"
  SOURCE 1..358: /mol_type="protein" /organism="Aetherobacter rufus"

SEQ ID NO: 137 - DNA, 17191 bp, Aetherobacter
  source 1..17191: /mol_type="DNA" /organism="Aetherobacter"
  CDS 1..1632: /codon_start=1 /product="domain pfa1" /transl_table=11
  CDS 1659..8327: /codon_start=1 /product="domain pfa2"
  CDS 8324..17191: /codon_start=1 /product="domain pfa3"
gtgcaaacctcgatttctcgtgtcgttcccgtcggtgcctttcgcgccggcagcaccgcgccggtgttcggcgcgtcggacctgatcgctgccgtcgcccgcgtgcgtgagcccgcgcacgtggtgcgggagggcatcgccgggcgcgtgggcgtcgccttcggcggcgaggtgctgcccgtggcgcaggcgagcgcggcgggcgcggtgccgctcctcgcgacgctgccggcgctctatcccgagtggctcggtgatcgatcgttcaacgaggttcatcgggtccgcttctcgtacgtggtcggtgagatggccaatggcatcgccaccacgcgcatggtcatcgaagcggcgcgcgcggggatgctcgggttcttcggcgccgcggggctcggcttcgagcgcgtggagaaggccatcgccgagctcacggcggcgctcggcgacgcgctcccgtggggcgtgaacctcatccattctcccaacgagccggagctcgaggagcgggtcgccgatctcttgattcagcgcggcgtggcccgcgtctccgcgtccgcgttcatggcgctcacgccggccgtggtgcggtatgcggcgagcgggctcacggtggatgcgtcgggcaacatcgttcgcccgcgtcacgtgttcgccaagatctcgcgcgccgaggtggcccgccgcttcatcagcccggcgcccgaggggatgctgcgcgccctcgtcgagcgcggcttgctcacgccgaacgaggctgcgctcgcggcgcgcgtgcccgtcgccgaggacgtcaccgtcgaggccgactccggtggtcacaccgacaatcaagcgctcaccgcgctctttcccaccattctctcgctgcgcgacgagatcgcggccaagcacggttacacgcgtcccattcgcgtgggcgccgcgggtggcctcggcacgccgggcgcggtggcggcggcgttcacgctgggcgccgcgtacgtgctcaccggctcggtgaaccaagccgcggtggaggctgggctctccgatcacggcaagaagatgctcgcgcaggccgacctcgccgacgtgatgatggcgcccgccgccgacatgttcgagctcggcgtgaaggtgcaggtgttgaagcgcggcacgatgttcggtgtgcgcgccgccaagctctacgaggcgtacgtcacgtatccctcgctcgaggccatcccgcccgaggtgcgcgcgcggctcgagaaggagacgctccacgcgacgttcgaccagatctgggccgacacgaagcagttttggcagcggcgcgatcccgccgaggtcgcgaagtgcgagcaggatccgaagcggcgaatggccctcgtgttccgctggtacctcggcaaggccagcaagtgggccatcgacggcgatccggatcggcgcgccgactaccagatctggtgtggaccggccatgggctcgttcaacgcctggacgcggggctcgttcctcgcggagccggcgaaccggaccgtggtgcagattggtttgaaccttctcgagggcgcggcggtcgtcacgcgcgcccaacagctccgcacgtatggcgtgcccgttccgccgggcgcgttcgactttaggccccgcgtcctcgcctgaaacacgcacgcatcgaggtctccacaatgccgcagatccccattgccatcgtgggcgtgagcgccctcttcgctggatccaccgacgcccagggtttctggcgcgacatcctcgcggggcgcgacctcatcaccgacgtgccgccgacgcactggctggtggaggattactacgatcccgatccttccgcgcccgacaagacgtactcgaagcgcggcgccttcctccccaacgtgcccttcgatcccatggagttcggcgtgccgccgagcatcgtgccggcgacggacacttcgcagctcctcgccctcatcgtcgcgcagcgcgtgctcgaggacgccacgcagggccagttcgccaagatgaaccgcgagcgcgccagcgtgatcctcggcgtcacctcgggccaagagctgctcgggacgatggtgagccggctgcaaaagccggtgtggatcaaggcgctgcgcgactccggcattccggaggacgaggcacaagccatctgcgatcgcatgtcgcgtgaatacgtgccttggcaggagtccaccttccccggcctgctgggcaacgtggtggccgggcgcatcgccaaccgcttcgatctgcgcggcaccaactgcgtcaccgacgcggcctgcgccagcgcgctctccgcggtctcgatggggatgagcgagctcgtcacggggcagtcggatctggtgatcgccggcggcgtcgacaccatgaacgacatcttcatgtacatgtgcttcagcaagacgcccgcgctctccaagagcggcgattgccggcccttctccgacgccgccgacggcacgctcctcggcgagggcatgagcatgatggcgctcaagcgtctcgccgacgccgagcgtgatggagaccgcgtttatgccgtgattcgcgggatcggatcgtcgtcggatggtcgcagcaagagcgtctatgcgccgctccccgagggccaggcgcgcgcgctccggcgcgcctacgaggtcgcgggctacgggcccgacaccgtcgagctggtcgaggcacacggcactgccacgaaagcaggcgacgccgcggagttcgagggcctccagatcgcgttcggcgaggccgggcgcacggatcggcagtggtgcgcgctcggatcggtcaaatcgcagatcgggcacaccaagtctgcggccggcgcggcgggcatgttcaaggcggtgatggcgctccatcacaaggtgctgccgccgacgatcaaggtggatcggccgaacccgaagctcgagatcgacaagagcccgttctacctcaacacccaggctcgcccgtggatccgcgatgcttcgcacccgcggcgcgcgtcggtgtcgagcttcggattcggtggcagcaacttccacctcaccatggaggagtacacggggccgggcgcgcgcgcgtcgctcctccgcagccatccggccgagctcgtgatgctcggcggcgcgagcgcgacggagctcgcagccaagtgcgcggaggccgtgaagcaggccgaggagctggggctcgccgcggtcgcgcgcacgtcgcaggagacgttccgcgcttcggatcgccatcgcctcgcggtggtggcgagcgacgcccaggatctcgcggccaagctcacgcaggcgcgcgcgaagctcgacgcggcgttctcgacgccgacggggattcattacggcatcggcgaaggcgcgggcccggtggccttcttgttcccggggcaggggagccaatacgtcggcatgggcgccgatgtcgccatgagcttcgatgcggcgcgcgccgtgtgggacgccgccgcggcgacacgcttcgatgaacttggtgtgcacgacgtggtgttcccgcggcccgtgttcaccgatgcggagcgcgaggcgcagacgaagcagctcacggcgacggagtgggcgcagcccgcgatcgggctcaccagcttggcgctgctcggcgtggtgcgcgcggtgggcgtcgcgcccgtgtgcgtgggcgggcacagcttcggcgagatcacggcgctggcggcggccggtgcgctcgatcaagcgagcgtcgtcgcggtggcgcgccgtcgcggcgagctgatgcgtgacgcgtcctcgacgccgggcgcgatgacggcggtggcgcgtcccatcgacgaggtgcgcgcgatcctcgcggagctcggcgatcgggtcgtcgtcgcgaaccacaaccatcccacgcaggtcgtgctctccggcgccgtcgacgagatcgcgcgtgtcgagcagcacctcgcgggcaagggcatcacggccaagcgcttgccggtggcgaccgcgttccacagcccgctggtggcgccgtcgtccgcgcgcttcgcggagcacctcgcggggatcccgttcgcggcgccgtccgtcgaggtgtggtccaacgcggaagcggcgccgtatggtgcggaggcggacgccattcgcggtcgcctcgccgatcagatcgcgcggccggtgcggttcgtggaggaagtcgaaggcatgtgggcccgtggggcgcgcgtcttcctcgagattgggccgggcgcggtgctcaccgaaatggtgggtcgcatcctcggcgatcggcagcacgtggcgatcgcgctggatcgcaagggcaagaatggtgtgaccagcttgcaggaggcgctcggccgcttggccgtggccggcgtggccatcgatttcgcgccgctgtgggccgggtatgcgcggccgggcgcgcccaagaagaagccggcgatgaccatccccatcaacggggccaaccacggcaagccctacccgccgccgcgcggcgcggccgccctgccgaagccgaatccgcctcgtccgaaggagatcgtgaaagtggctgcgcctccgtcctctgtctcgacgcctgtcgccgcgcccgcacccgttgcggcggctcccattgccgcgcccgcgcccattgcggtggctgcgcccattgccgcgcccgcacccattgcggcggctgcgcccatcgcggcgcgcgcgcccattgcgacggccgtgcccgtcgcggcgatgccgaacgacgcgcacctggcttgggtgcgtgcctatcaggagtcgcagcgccagacggcggaggcgcacgcggcctatctcaggacgatggccgacacgcacgcgaccttcctgcgcacggtggagtcgtcgttctcgggcctctccgcgatggtgactgggcagccgatgatgcctgtggcgcacacgacgccgagcgtccacgcggcgcccatcgcgatgttcgcggcgccgccgcccgtcgccgcgcttcccgcgccgcccattgcggtggctgcgcccgctccggcggcgtccattgcaatggctgcgccggcggcgcccattgcggtggctgcaccggtagcgcccattgcggtggctgcgccggctccggtggtcgcggcgcctgctccggtggcgcccaaggctgctgccgcgggtgtcgatctgcaggcgctgatgctgacgatcgtggcggagaagactgggtatccggtggagatgctcgggcttcagatggagctggaggcggacctcgggatcgattcgatcaagcgggtggagatcctgtcggcgatgcgggagcgcgcgccggggctgcccgaagtgaatgccagtgagatggcggcgcttcggacgctcgatcagatcgtcgagtacatgcgcgcgcgcggcgccgtcacggcaccttcggcgcctgcgccggaggcagcgcaagcggctgcaccggccgcgccttccgccgatctggaagcgttgatgctgacgatcgtggcggagaagactgggtatccggtggagatgctcgggcttcagatggagctcgaagcggacctcgggatcgattcgatcaagcgggtggagatcctgtcggcaatgcgagagcgcgcgccggggctgcccgaagtgaatgccagtgagatggcggcgcttcggacgctcgggcagatcgtcgattacatgcgtgcgcggagcggcaatgctgcgcctgcggcgcgcccgcaggcggcgagcgcaccggccgcgccggcagcggcgccgtccgtcgatctggaagcgttgatgctcacgatcgtcgcggagaagacgggctatccggtggagatgctcgggcttcagatggagctggaggcggacctcgggatcgattcgatcaagcgggtggagatcctgtcggcgatgcgggagcgcgcgccggggctgcccgaggtcaatgccagtgaaatggcggcgcttcggacgctcggacagatcgtcgagtacatgcgtgcgcggagcggcaatgcgggagcgaaggctccggcggcgccggtcgcggctgcgaccgcggaggcagcggtgcccgcggcgtctgcgattcaacgcttcgtgctgatcgaggaggcggcgacgccgtgcgggctcgccatgtcggggctgctcggggcgcgacgcgtggtggtgaccgaggacggcggtggtgtcgcagcggcggtcgtgcgcgcgctcgatgtgcgcggcgtgaaggccgaggtcgtggacacggtgagcggcgagccggacgtggtgatcttcctcggcggcctgcgcgcggtcgcgacggtggatgaagccgtcgcggtgaatcgcgaggcgttccgcgcggccaagtcgatcgcggcgcgcttcgcggcgagcggaggggtgctcgtcacggtgcaggacacgggcggcgatttcgggctctcgggtcgtgacgagcggcgggcgtggctcggtggtgtctcggcgctcgcgcgcaccgcggccatcgagtggccgagcgccgcggtgaaggcggtcgatctggagcgcggcggtcgcagcccggaggcgctcgccgaggtgctcgtgcaggagctcttcacgggcggcgcgacgcgcgaggtcgggctccatgccgatggcacgcgcacgcgcctccgcagtgtcgcgcgcgaggccgtgcctgccgcctccgtcgtggatcaagagagcgtcgtggtggtgtcgggcggtgcgcgcggcgtgacggcggcgtccgtcatcgcgctggcgcagcaggcccggccgcgcatcgtgctgctcgggcgctcgcgcctggaagaggagccggcggcgtgccgcggcgtcaccgacgacgcggggctcaagcgcgcgctgctcgaagacgccaaggcgcacggtcgcacggtcgcgcctgcggagctcggggcaggcgtcgcgcgcatccaagcgaaccgcgaggtgcaggcgacgatcgcggcgattcgcgcggcgggatccgaggtccgctacgtgccggtcgacgtgcaggatgcgcgcgggctcgcggcggcgctcgacgatgcgcggcgcacgtgggggccgatcaccggcatcgtgcacggcgccggcgtgctcgcggacaagctcatcgcggagaagaccgcggagcagttcgatcgggtcttcgatacgaaggtgctcgggctccgcgcgctgctcgacgccacggcgagcgatccgctacgcttcgtgtgcctgttctcctccgtcgcggcgcgcacgggcaacctcgggcagagcgactacgcgatggccaacgaggtgctcaacaaggtcgcggccgcgatgcgccacgcgcgcggaggatcgttcgtcgccaagtcgatcggctggggcccgtgggagggcggcatggtgacgccgtcgctcaaggcgcgcttcgatcagatgggcgtcgcgctcatcccgcttgcggatggagcgcgacgcttcgtcgcggagctctcgggctcgcccgacgaggtggagacggtggtgggcggcgccatgggcgacggcgcgctgggcgccgcggcgggatccgtcgtgtccgcggaggtcacggtggggatgcgatcgcatccgtacctcggcgatcaccgcgtcggtggcaagccggtggtgcccgtggccatggccatcgagtggatctcgcgcgccgcgcgcgcgctccgtcccgatgccggcgcggtggtgctgcgtgatctcaaggtgcttcggggcatcaagctcgatcacttcgagaacggcggcgatcggctctcgctctcgtgcaagccgcgcgcgaacggccgcgccggcgagctcaccgtcgagctgcgcgggcgcgacggcgtgctccactacagcgccaacgtcgaggccgcccgcgagccgcagcccttgccgaaccgcgcgcccgagccctcgctcggcacgtggacgcacgaggtcgtgtacgacggccacgttctcttccacggcccgagcttccaggtgattcgatccatcgacggcgtctcccgcgaaggcatcgcggggagcctcaccggcacgcgcgagcgtggttgggccgaggaagcgtggcgtgtcgatcccgcggccctcgacggtgccttgcagctcgcggtgctgtgggcgcgcgacgtcctcggtggtgcgtcgctgccgatggcggtcgcggagttcgagagcttcgtcgacggtctcccggaggcaccgatccgctgcatcgtgcgcggccgtgaagtgcacgcgcagcgcgcggtgtgcgaggtgacgctcgaggatgcgtccggtcggcccatcgcggcgctgcgcggcgtggagaccatccttcgtccgggggagcagcccggccggaccgccgcgcaggcgggcgcggcctcgtgaggttcgagccgatcgccatcgtcggcgagggctgcgtcctgccgggcgcggcctcgccgtccgcgctccgcgaggccgtgctcgcggggcgcaacgcggtcacgggcgtgcccgacggacgctggcgactccccgccgcgcactccatgggcacgcccgatcacgcggtggatcgcgcctggtccgacgccggcggatacgtggagggcttcgagcccagcttcgatccgaccggcttccatctgtctgcagaccgcgtgcgcgcgctcgattcctcgttccgttgggtgctccacgccgctcgccaagcgctcgcattcgccggcgcctcgcgggcctcggcgcgcgccgggctcgtgctcggcaacctctcgttcccgacggcgacgatgacgcgcttcgccgagagcgtgtggctcgacgcgcagggcgaggcgttcctcggcggccgcgcgcgtgcgctcgcgggcgtcgatcgacccgatccgcaaaaccgcttcatgtccggcttccccgtgcagctcgcggccgaagccctcggcctcggcgcgggtggcttcgcgctcgacgcggcctgcgcctcgtcgctctacgccatcaagctcgcgtgtgatcgcctccacgatcgctcggccgatctcatgctcgcgggcgccgtcaacgccgcggacaacctcttcctccacgtcggcttctgcgcgctcgcggccatgagccgcacgggccagagccgcccgttccatcgcgatgccgacgggctcgtgcccgccgaaggcgccgccgtcgtcgcgctcaagcggctcgccgatgcgcgcgacgcgggcgatcgcatcctcggtgtgatccgcggcgtcggcctctccaacgacggtcgcggtcgcggcctcctcgcgcccgcggaggaagggcagatccgcgccatgcgcgcggcctacgcgatgtcgggcctcacgcccgcgcacgtctcgctcgtcgagtgtcacgccaccggcacgcccgtgggcgacgccaccgaggtgcgctcgatgaccgcgctcttcgaaggcctgcgcgacgtgcccatcggctcgctcaaatcgaacctcggccacctcatcacggtggccggcgtcgctggtctcatgaaggtgctcggcgccttcgcggccggcctgcggcctcccacgctgcacgccgacgcgcccatcgacgcgctccgcggctccccgttccgcttgctgacgagcgccgaggaatggcccgccaacggcccgcgcgtcgcggccgtcagcgccttcggcttcggtggcaacaacgcgcatctcctcgtcaccgaggacgatgccggcgcctccgtgacctcgttcgtccccgcatctcccgcgccgcccatcgccgtcgtcggcatcggcgccatgctcggcgacaccacgggcgcggatgccgccgcgcgcgccgtgctctccggcgagcgctggaatccgcggcgcaccgacgtcaccgtcgcgctcgaagggctgcgcgtcccgcctcgcgatctcgagcagacgcttccccaacagctcctcgcgctcgaagccgcgcgcgaagccgtgcggggcatcacgctcccgcgcgagcgcaccggcgtgctcgtcggcatgggctgcgatcccgagatcgcccgctacggcacgcgctggcgcctcgcggattgggcggacacctgggcctctcgcgaaggcaaggtcgtctccgacgattggctctcccgcgcccgcgatgccgtgcagaccaagctccaggccgcgggcgtcgtggggacgatgcccaacatccccgcgaaccgcatcaacagccagctcgatctcgccggcctcggctacaccgtctccgccgagcaggcctcgggcattgtcgccttggagatcgccgcgcgcgcgctgcgtgaaggcgagctcgacgccgccgtcgtgggcgccgtcgatctctcggacgagcccgtgcaccgcgccgcgctcggccccgacgcgaagcccggcgatgccgccgtcgtgctcgtcctcaagcgtctcgacgacgcgcgtcgcgacggcgatcgcgtcctcgccctcctcgacggcgacggccccgccacgctccgcatcggcgacggcggcatcgatccttccgcgcatgcgaccgcgcacgccgccgccggcctcgttcacgtcgccaccgccatctggagcgtctttcacggcgcgcgccccgccgatggacgcgccgccacaccgtggctcggcacccgcagcgccgagaccgtgacacgctcgctcgccggcgcgcccaccaccgtgcgcatcgcgtccgccgcgccgccggccccgctcgccttcgagcctccgccgcgcctccacgtgatcgccggcgccgatcgcgccgccgtgatccgcgcgctctccggtggccccatctccaccgaaggcccggcccgcctcgtcatcgtcgccgcgaccgacgaagagcgcacgacccgtctcgcacaggccaaacgctacctcgaaaaaggcggccccgcgcccgagggcatcgcctaccgcgacgcgcccctcgccggcgatctcgccttcgtcttcaccggcgccgccgcttcctacgttggcatgggccgcgagctcgcgctcgcattgccctccgccgtcacgcgcctcggcgcgcgcttcgcgaccctcgcggacgcgacccgttggatcttcggcccgcccgccgcgcccaatcacccgctcgagcagctctgggcgagcgccttcctctgccagctccacgtggagatctcgcgcggcatcctgggcctcacgccgcaggcgaccattggttattcgtccggcgagagcaatgctctcttcgcttcgggcgcctggcgcgatctcgacgccatggtcgccgaatcgtggaagagccccattttcaccgacggcatcgtcggcgacttcaccgccgcgcgtcgcgcctggcgcaagctcggcagcgacggcacgtgggaggcatggagtgtcgccgcccccgtcgaagccgtccgcgaagcgctccgcggcgagcccacggcgcacctgaccatcatcaacacccccgaggactgcgtgatcggcggcgaggcctccgccgtcggccgtgtcctcgacaagctcggtcgctcccgcgcgctcccgctcgactacgaaatggccgcgcattgcccggagatcgaagagatccgaaaggagtggtacgacctccatcaccgcgccacgtcggacgttcccgacatccgcgtctactccgccggcagcgcgaccgccttccaagccacctcggatcgcgcggcggcggccatcactgcgcaggccgtgggcacgctcgatttcccccgcatgatcgagcgcgcctatgccgacggcgtccgcatcttcgtggagcacggcccgcgcggcctctgcagtggttgggtcaaacgcatcctcggtgaccgcgagcacctcgccgtttcactcgacgtcgccggcaggagcggtgtccgccagctcgccaatgccgcagctgccttggtcgccgcgggcgtccccgtcgacaccgacgcgctccattccgcgctcggcgaaggcgcgcgcatcgataagcccaccggcgccaccatgcgaatccccgcccatccgccggccattcaactccctccattcgagtcttccgtgcaagtgatggtgcccgcgcctccgctcccgcccgtgttggagcaaccgctctccgccgcgatcccggtgcctcgtcccgagagccccaaagcctcctcgccgacaccgcatctcgcgacacccaccgtgaccgccccgccgccggtgcccctcgcggccgcgcctctgcctgccgcgacaacccttctcccggccccggcggcacccgagctcacggtcacgccatctcccacggtggagatcctggcccgcgccacacaacaacacgccctcctcggcgccattcatcgcgacttcctggaagcccaggccgcggcgcacacccagttcctcgcgctccagcaaaccatgctggccggcttgatgagggcctattcgagcgccccgccgagccccgccgtcgagctcctcgagcacccggtcaccgtctctcaggtcctcccggatcctgtgcaaattcaacagcctgcaccggactcggcacctcccgcgaccccgctccgcgcggcgccgcccccgagcgctctgcctcgtccggcagccgtctcgccgcctccgagcattctgcctctcccggccgccgccgcgccgccggtgtccctctcgcgccccgccccggtcgcgaaagccacgctccccggccccaagtacgatagggctcagctcgaggtcctcgcctccggcaacatctcttccgtcttcggcccagccttcgccgatcaggatggcttccaccgccaagtccgcatgcccatgccgccgctccttttggcggatcgggtgacgggcatcgccggtgagcatcacgcggtggggactggcaccatctggacggagacggacgtcaccaccgagagttggtatctccacgagggccgcatgcccgcggggatcatgatcgagtcgggtcaagccgatctcctcctcatctcctggcagggcgccgaccgccagaatcgcagcgagcgtgtctatcgcctcctcggctgcgacctcacgtatcacggcgagctgcccaagccgggcgacacgctcgtttacgacatccacatcgatggccacgcccgccagggcgacattcgtctcttcttcttccactacgattgtcgcatcaatggtgagctgcgcctctcggtgcgcagcggccaggccggcttcttcaccgaggccgagctcgccgactccggcggcatcctctgggacgcgcagacgggtgagcaccgcaccacgggcccgctcgatcctcccgccgtcgcttgcgccaaacgcagcttcacggagaccgaagtccgcgccttcgccgacggacgcgtggtcgattgtttcggccccggcttcgaaaagaccctcgcccacgtgcgcacgccgcgcatccagtccgagcgcatgctcttcctccgcgaggtcgtcgagttcgatccgcgcggcgggccttggggacgcggatacctgcgcgccgaagcgcccatcacgcccgatgattggtatttcacggggcacttcctcaacgacccttgcatgcctggaactctgatgttcgagggctgcgtgcaggccatgtcgttctacctcgtggccatgggcttctccgtcgatcgcgacggctggcgcttcgagcccgtcgccggccacaagatccccatgcgctgccgcgggcaggtcatcccgagctcgaagcgcctcacctacgaagtcttcgtcgaagaggtgattgcggggccagtgcccaccgtctatgccgatctcctctgcaccgtggatggcctcaaggcctttcacgcgcggcgtgtcggcctcaagctcgtccccgattggccgctcgccgattgggctcatcttcccgtcgcctccgccgcggatccggcccatcgcaccatggatcagcggaagctcggcggtctcgccggctgggtggagccgaagccggtggcctcgcacgagggcttcccgttcgattatccctcgctcctcgcctgcgcctgggggcgcccgtcggcggcgttcgggcccatgtatgcgcccttcgacggcccgcgcaacgtggcccgtttgcccgggccgccctatcacttcatgtcacgcatcacccgcacggacgcgcccatgggcgccttccgcgcgggcgcatcgatcgaggccgaatacgatgtcccgaaggaggcgtggtatttcgatctcaacgggcaccccaccatgcccttctgcgtgctcatggaggccgcgctccagccttgtggttggctcgcgagctacatcgggagcacgctcaccgccgacatcgatctcatgttccgcaacctcgatggaacggggacgttgctcgcggaggtcctgcccacctcgggcaccctgcgcacgcgcgccaaggtgacggacgtctcccgctcggcggggatgatcatcgagtcgttcgaggtcgagtgcttcgtcggcgacacctgcgtttacaagatgaagaccgtcttcgggttcttccccaaagaggccttcgaaaaccaggtgggtttgcccgtcaccccggaggagcgcgcccgcctcgaggctccctcctcgtatctcgtcgatctgcggagccgcccgtcacgctacttcgaggcctcgccccgcctgcccgagcccatgctctgcatgctcgatcgcgtcaccgcgtgggtgcccgagggcggcaaaaaggggctcggttgggcccgcggcgagaaggacgtcgatgcgagcgagtggttcttcaaagcccacttcttccaagatcccgtgcaacccgggtcgctcggcatcgaggcgctcgtccagctcctgcaattcgccatgatggagcggggcatggccgagggcgtgcccggcgcgcgcttcgagccggtcgcggtgggcaagccttccgtctggaaataccgcggtcaggtggtgccctcgaatcgccgcatcaccaccgagatcgacatcctcgaagtcggtgaggacgagcgcggtcgcttcgcggtggcggaaggctcgttgtgggtcgacggcaaacgcatctaccacaccaagtctctcgccatgcgcatcgtccccggcggcgcgcccccgcgcgggcctcgtgtcgggcaaccgcgtgaggaaacgctcgatgccgcggtcgacacgtggctcggcgatcatcggcccacgtggacgctgcccgcgctgccgatgatgtcgatggtcgatcgcctcgccgcggccgcgcagccttcgccgagcgggcgcgtcgtggagatcgccgacgtgcaagtgaagcgctggctcccgttcccgggcggccccgtgcgtctcaccacggaggtgaatcatcgcgacgacggagagcacgtcaccctgctcgccttccgcgaagcgcgtgacgccgcgctctcgcgcttcgagcccgtggccacgggccgcgtgcgtctcgcgccgcgtttcccggcgccgcccgcgcccttcgcgccgctcgcggacgccgcgcccatcgacgatccgtatgcctcgggcgcgctgttccacggcccctcgttccagatgctgcggtctctgcgcttcgggtccaaaggcgcttccgccatcctcgacatggccgagcgcggcgtcccccgcggggcgcttcatcaaggcctcctcgacgcgctcacccacgccattccccacgacgatctctcccggtggtcgcccgacatcgaaggcgatcaggtgggctatccctaccgcattccctcgattcgtttcttcggcgaaatgccttctgcgggagaaggccaattggaggtgcgcttcgccggcttcgacggacaaccgcgcttcccgaaattcgaggtccagctcctcgtcggcggcgtggtgcgcgtcgccctcacgctcgtcgaagtgctcctcccgcgcggccccatcggacagcggagccgcgcggatcgccgcgcgttcctgcgcgatcggcgcttcgtgccgggcgtgcgcctctcgcgcgccgagggcgccctcaccgtggctgcccccgaggacgtgaagccgagcgattggctccctggcaacgtcgcctgcatctatggagtcgccccgggcgccgatctcgtggccgaagtcgcggtgcgcgatcacctcgcccaacgtgccttcgtgcacccgagcaccgtgcgcccgagcgcggacctcgccgacgccacggtggccatgcggcctttgcgccggcatttcctcgacgtgcggcgcgacggcgacacggtgcgcgtctccgatgctcgcccgccggccatggacctcggcccggtggaagcgcattggcgcaagtggttcggcatcggcgcctggccggtggaggacctttattacggcctcatcgagcgcttcgtcggcgacgtggtgatcgccgatcccgaggccttcgccaaggtgcgcgggcggagctgcctttacctcgccaatcaccaggtcgcggtggagtcgctcctgttctcggtgctcgtctcggcgctctcgggcgtctccacgatcacgctggccaaggccgagcaccgggcctcgtgggtgggcgagctcatccggcagagcttcagttatcccggcatcaccgatcccggcctcatcacgttcttcgatcgcgaagatcgagagtccttgatgcgcatcatcggcgacctcgccgccgaaatggcccaacagggcaagagcgccatggtgcacgtcgaaggcacgcgctccctctcgtgccggcacccggtggtgaagatgagctccgcgttcatcgacatggcgctcgccgtgggcgcgcccatcgtgcccgtgcgtttcgtgggcggtttgccggccgaagagctctcgcaacgcatcgagttccccgtcggccacggtcgccaagacttctggctcggccgccccgtgctcccggaagagctgcgcgccctgccgctcaaagagcgcaagcaagtcgtgatcgacgccatcaatggcctcggtcccggcccgcagcacgaggagcctcatccgggggacaccgcgttcaccgcgcgcgtcgagtcctggaagccgcgcaccggcggcaacgcggagcgcgccacgctgctcgcgaccctggaggcgctgccggcccatcgctccgaagcgacggggaggctcgtcgagagcgcccgcgaagggcgttcgagctttggtgcggagccgagcgagcaatggctctctgggtttgcgcgctggctcttgggtggctga

SEQ ID NO: 138 - protein, 543 aa, Aetherobacter
  SOURCE 1..543: /mol_type="protein" /note="This sequence is generated from feature [CDS]: 1..1632 placed under sequence number 137" /organism="Aetherobacter"
VQTSISRVVPVGAFRAGSTAPVFGASDLIAAVARVREPAHVVREGIAGRVGVAFGGEVLPVAQASAAGAVPLLATLPALYPEWLGDRSFNEVHRVRFSYVVGEMANGIATTRMVIEAARAGMLGFFGAAGLGFERVEKAIAELTAALGDALPWGVNLIHSPNEPELEERVADLLIQRGVARVSASAFMALTPAVVRYAASGLTVDASGNIVRPRHVFAKISRAEVARRFISPAPEGMLRALVERGLLTPNEAALAARVPVAEDVTVEADSGGHTDNQALTALFPTILSLRDEIAAKHGYTRPIRVGAAGGLGTPGAVAAAFTLGAAYVLTGSVNQAAVEAGLSDHGKKMLAQADLADVMMAPAADMFELGVKVQVLKRGTMFGVRAAKLYEAYVTYPSLEAIPPEVRARLEKETLHATFDQIWADTKQFWQRRDPAEVAKCEQDPKRRMALVFRWYLGKASKWAIDGDPDRRADYQIWCGPAMGSFNAWTRGSFLAEPANRTVVQIGLNLLEGAAVVTRAQQLRTYGVPVPPGAFDFRPRVLA

SEQ ID NO: 139 - protein, 2222 aa, Aetherobacter
  SOURCE 1..2222: /mol_type="protein" /note="This sequence is generated from feature [CDS]: 1659..8327 placed under sequence number 137" /organism="Aetherobacter"
MPQIPIAIVGVSALFAGSTDAQGFWRDILAGRDLITDVPPTHWLVEDYYDPDPSAPDKTYSKRGAFLPNVPFDPMEFGVPPSIVPATDTSQLLALIVAQRVLEDATQGQFAKMNRERASVILGVTSGQELLGTMVSRLQKPVWIKALRDSGIPEDEAQAICDRMSREYVPWQESTFPGLLGNVVAGRIANRFDLRGTNCVTDAACASALSAVSMGMSELVTGQSDLVIAGGVDTMNDIFMYMCFSKTPALSKSGDCRPFSDAADGTLLGEGMSMMALKRLADAERDGDRVYAVIRGIGSSSDGRSKSVYAPLPEGQARALRRAYEVAGYGPDTVELVEAHGTATKAGDAAEFEGLQIAFGEAGRTDRQWCALGSVKSQIGHTKSAAGAAGMFKAVMALHHKVLPPTIKVDRPNPKLEIDKSPFYLNTQARPWIRDASHPRRASVSSFGFGGSNFHLTMEEYTGPGARASLLRSHPAELVMLGGASATELAAKCAEAVKQAEELGLAAVARTSQETFRASDRHRLAVVASDAQDLAAKLTQARAKLDAAFSTPTGIHYGIGEGAGPVAFLFPGQGSQYVGMGADVAMSFDAARAVWDAAAATRFDELGVHDVVFPRPVFTDAEREAQTKQLTATEWAQPAIGLTSLALLGVVRAVGVAPVCVGGHSFGEITALAAAGALDQASVVAVARRRGELMRDASSTPGAMTAVARPIDEVRAILAELGDRVVVANHNHPTQVVLSGAVDEIARVEQHLAGKGITAKRLPVATAFHSPLVAPSSARFAEHLAGIPFAAPSVEVWSNAEAAPYGAEADAIRGRLADQIARPVRFVEEVEGMWARGARVFLEIGPGAVLTEMVGRILGDRQHVAIALDRKGKNGVTSLQEALGRLAVAGVAIDFAPLWAGYARPGAPKKKPAMTIPINGANHGKPYPPPRGAAALPKPNPPRPKEIVKVAAPPSSVSTPVAAPAPVAAAPIAAPAPIAVAAPIAAPAPIAAAAPIAARAPIATAVPVAAMPNDAHLAWVRAYQESQRQTAEAHAAYLRTMADTHATFLRTVESSFSGLSAMVTGQPMMPVAHTTPSVHAAPIAMFAAPPPVAALPAPPIAVAAPAPAASIAMAAPAAPIAVAAPVAPIAVAAPAPVVAAPAPVAPKAAAAGVDLQALMLTIVAEKTGYPVEMLGLQMELEADLGIDSIKRVEILSAMRERAPGLPEVNASEMAALRTLDQIVEYMRARGAVTAPSAPAPEAAQAAAPAAPSADLEALMLTIVAEKTGYPVEMLGLQMELEADLGIDSIKRVEILSAMRERAPGLPEVNASEMAALRTLGQIVDYMRARSGNAAPAARPQAASAPAAPAAAPSVDLEALMLTIVAEKTGYPVEMLGLQMELEADLGIDSIKRVEILSAMRERAPGLPEVNASEMAALRTLGQIVEYMRARSGNAGAKAPAAPVAAATAEAAVPAASAIQRFVLIEEAATPCGLAMSGLLGARRVVVTEDGGGVAAAVVRALDVRGVKAEVVDTVSGEPDVVIFLGGLRAVATVDEAVAVNREAFRAAKSIAARFAASGGVLVTVQDTGGDFGLSGRDERRAWLGGVSALARTAAIEWPSAAVKAVDLERGGRSPEALAEVLVQELFTGGATREVGLHADGTRTRLRSVAREAVPAASVVDQESVVVVSGGARGVTAASVIALAQQARPRIVLLGRSRLEEEPAACRGVTDDAGLKRALLEDAKAHGRTVAPAELGAGVARIQANREVQATIAAIRAAGSEVRYVPVDVQDARGLAAALDDARRTWGPITGIVHGAGVLADKLIAEKTAEQFDRVFDTKVLGLRALLDATASDPLRFVCLFSSVAARTGNLGQSDYAMANEVLNKVAAAMRHARGGSFVAKSIGWGPWEGGMVTPSLKARFDQMGVALIPLADGARRFVAELSGSPDEVETVVGGAMGDGALGAAAGSVVSAEVTVGMRSHPYLGDHRVGGKPVVPVAMAIEWISRAARALRPDAGAVVLRDLKVLRGIKLDHFENGGDRLSLSCKPRANGRAGELTVELRGRDGVLHYSANVEAAREPQPLPNRAPEPSLGTWTHEVVYDGHVLFHGPSFQVIRSIDGVSREGIAGSLTGTRERGWAEEAWRVDPAALDGALQLAVLWARDVLGGASLPMAVAEFESFVDGLPEAPIRCIVRGREVHAQRAVCEVTLEDASGRPIAALRGVETILRPGEQPGRTAAQAGAAS

SEQ ID NO: 140 - protein, 2955 aa, Aetherobacter
  SOURCE 1..2955: /mol_type="protein" /note="This sequence is generated from feature [CDS]: 8324..17191 placed under sequence number 137" /organism="Aetherobacter"
VRFEPIAIVGEGCVLPGAASPSALREAVLAGRNAVTGVPDGRWRLPAAHSMGTPDHAVDRAWSDAGGYVEGFEPSFDPTGFHLSADRVRALDSSFRWVLHAARQALAFAGASRASARAGLVLGNLSFPTATMTRFAESVWLDAQGEAFLGGRARALAGVDRPDPQNRFMSGFPVQLAAEALGLGAGGFALDAACASSLYAIKLACDRLHDRSADLMLAGAVNAADNLFLHVGFCALAAMSRTGQSRPFHRDADGLVPAEGAAVVALKRLADARDAGDRILGVIRGVGLSNDGRGRGLLAPAEEGQIRAMRAAYAMSGLTPAHVSLVECHATGTPVGDATEVRSMTALFEGLRDVPIGSLKSNLGHLITVAGVAGLMKVLGAFAAGLRPPTLHADAPIDALRGSPFRLLTSAEEWPANGPRVAAVSAFGFGGNNAHLLVTEDDAGASVTSFVPASPAPPIAVVGIGAMLGDTTGADAAARAVLSGERWNPRRTDVTVALEGLRVPPRDLEQTLPQQLLALEAAREAVRGITLPRERTGVLVGMGCDPEIARYGTRWRLADWADTWASREGKVVSDDWLSRARDAVQTKLQAAGVVGTMPNIPANRINSQLDLAGLGYTVSAEQASGIVALEIAARALREGELDAAVVGAVDLSDEPVHRAALGPDAKPGDAAVVLVLKRLDDARRDGDRVLALLDGDGPATLRIGDGGIDPSAHATAHAAAGLVHVATAIWSVFHGARPADGRAATPWLGTRSAETVTRSLAGAPTTVRIASAAPPAPLAFEPPPRLHVIAGADRAAVIRALSGGPISTEGPARLVIVAATDEERTTRLAQAKRYLEKGGPAPEGIAYRDAPLAGDLAFVFTGAAASYVGMGRELALALPSAVTRLGARFATLADATRWIFGPPAAPNHPLEQLWASAFLCQLHVEISRGILGLTPQATIGYSSGESNALFASGAWRDLDAMVAESWKSPIFTDGIVGDFTAARRAWRKLGSDGTWEAWSVAAPVEAVREALRGEPTAHLTIINTPEDCVIGGEASAVGRVLDKLGRSRALPLDYEMAAHCPEIEEIRKEWYDLHHRATSDVPDIRVYSAGSATAFQATSDRAAAAITAQAVGTLDFPRMIERAYADGVRIFVEHGPRGLCSGWVKRILGDREHLAVSLDVAGRSGVRQLANAAAALVAAGVPVDTDALHSALGEGARIDKPTGATMRIPAHPPAIQLPPFESSVQVMVPAPPLPPVLEQPLSAAIPVPRPESPKASSPTPHLATPTVTAPPPVPLAAAPLPAATTLLPAPAAPELTVTPSPTVEILARATQQHALLGAIHRDFLEAQAAAHTQFLALQQTMLAGLMRAYSSAPPSPAVELLEHPVTVSQVLPDPVQIQQPAPDSAPPATPLRAAPPPSALPRPAAVSPPPSILPLPAAAAPPVSLSRPAPVAKATLPGPKYDRAQLEVLASGNISSVFGPAFADQDGFHRQVRMPMPPLLLADRVTGIAGEHHAVGTGTIWTETDVTTESWYLHEGRMPAGIMIESGQADLLLISWQGADRQNRSERVYRLLGCDLTYHGELPKPGDTLVYDIHIDGHARQGDIRLFFFHYDCRINGELRLSVRSGQAGFFTEAELADSGGILWDAQTGEHRTTGPLDPPAVACAKRSFTETEVRAFADGRVVDCFGPGFEKTLAHVRTPRIQSERMLFLREVVEFDPRGGPWGRGYLRAEAPITPDDWYFTGHFLNDPCMPGTLMFEGCVQAMSFYLVAMGFSVDRDGWRFEPVAGHKIPMRCRGQVIPSSKRLTYEVFVEEVIAGPVPTVYADLLCTVDGLKAFHARRVGLKLVPDWPLADWAHLPVASAADPAHRTMDQRKLGGLAGWVEPKPVASHEGFPFDYPSLLACAWGRPSAAFGPMYAPFDGPRNVARLPGPPYHFMSRITRTDAPMGAFRAGASIEAEYDVPKEAWYFDLNGHPTMPFCVLMEAALQPCGWLASYIGSTLTADIDLMFRNLDGTGTLLAEVLPTSGTLRTRAKVTDVSRSAGMIIESFEVECFVGDTCVYKMKTVFGFFPKEAFENQVGLPVTPEERARLEAPSSYLVDLRSRPSRYFEASPRLPEPMLCMLDRVTAWVPEGGKKGLGWARGEKDVDASEWFFKAHFFQDPVQPGSLGIEALVQLLQFAMMERGMAEGVPGARFEPVAVGKPSVWKYRGQVVPSNRRITTEIDILEVGEDERGRFAVAEGSLWVDGKRIYHTKSLAMRIVPGGAPPRGPRVGQPREETLDAAVDTWLGDHRPTWTLPALPMMSMVDRLAAAAQPSPSGRVVEIADVQVKRWLPFPGGPVRLTTEVNHRDDGEHVTLLAFREARDAALSRFEPVATGRVRLAPRFPAPPAPFAPLADAAPIDDPYASGALFHGPSFQMLRSLRFGSKGASAILDMAERGVPRGALHQGLLDALTHAIPHDDLSRWSPDIEGDQVGYPYRIPSIRFFGEMPSAGEGQLEVRFAGFDGQPRFPKFEVQLLVGGVVRVALTLVEVLLPRGPIGQRSRADRRAFLRDRRFVPGVRLSRAEGALTVAAPEDVKPSDWLPGNVACIYGVAPGADLVAEVAVRDHLAQRAFVHPSTVRPSADLADATVAMRPLRRHFLDVRRDGDTVRVSDARPPAMDLGPVEAHWRKWFGIGAWPVEDLYYGLIERFVGDVVIADPEAFAKVRGRSCLYLANHQVAVESLLFSVLVSALSGVSTITLAKAEHRASWVGELIRQSFSYPGITDPGLITFFDREDRESLMRIIGDLAAEMAQQGKSAMVHVEGTRSLSCRHPVVKMSSAFIDMALAVGAPIVPVRFVGGLPAEELSQRIEFPVGHGRQDFWLGRPVLPEELRALPLKERKQVVIDAINGLGPGPQHEEPHPGDTAFTARVESWKPRTGGNAERATLLATLEALPAHRSEATGRLVESAREGRSSFGAEPSEQWLSGFARWLLGG

SEQ ID NO: 141 - DNA, 1632 bp, Aetherobacter
  source 1..1632: /mol_type="DNA" /organism="Aetherobacter"
  CDS 1..1632: /codon_start=1 /product="domain pfa1" /transl_table=11
gtgcaaacctcgatttctcgtgtcgttcccgtcggtgcctttcgcgccggcagcaccgcgccggtgttcggcgcgtcggacctgatcgctgccgtcgcccgcgtgcgtgagcccgcgcacgtggtgcgggagggcatcgccgggcgcgtgggcgtcgccttcggcggcgaggtgctgcccgtggcgcaggcgagcgcggcgggcgcggtgccgctcctcgcgacgctgccggcgctctatcccgagtggctcggtgatcgatcgttcaacgaggttcatcgggtccgcttctcgtacgtggtcggtgagatggccaatggcatcgccaccacgcgcatggtcatcgaagcggcgcgcgcggggatgctcgggttcttcggcgccgcggggctcggcttcgagcgcgtggagaaggccatcgccgagctcacggcggcgctcggcgacgcgctcccgtggggcgtgaacctcatccattctcccaacgagccggagctcgaggagcgggtcgccgatctcttgattcagcgcggcgtggcccgcgtctccgcgtccgcgttcatggcgctcacgccggccgtggtgcggtatgcggcgagcgggctcacggtggatgcgtcgggcaacatcgttcgcccgcgtcacgtgttcgccaagatctcgcgcgccgaggtggcccgccgcttcatcagcccggcgcccgaggggatgctgcgcgccctcgtcgagcgcggcttgctcacgccgaacgaggctgcgctcgcggcgcgcgtgcccgtcgccgaggacgtcaccgtcgaggccgactccggtggtcacaccgacaatcaagcgctcaccgcgctctttcccaccattctctcgctgcgcgacgagatcgcggccaagcacggttacacgcgtcccattcgcgtgggcgccgcgggtggcctcggcacgccgggcgcggtggcggcggcgttcacgctgggcgccgcgtacgtgctcaccggctcggtgaaccaagccgcggtggaggctgggctctccgatcacggcaagaagatgctcgcgcaggccgacctcgccgacgtgatgatggcgcccgccgccgacatgttcgagctcggcgtgaaggtgcaggtgttgaagcgcggcacgatgttcggtgtgcgcgccgccaagctctacgaggcgtacgtcacgtatccctcgctcgaggccatcccgcccgaggtgcgcgcgcggctcgagaaggagacgctccacgcgacgttcgaccagatctgggccgacacgaagcagttttggcagcggcgcgatcccgccgaggtcgcgaagtgcgagcaggatccgaagcggcgaatggccctcgtgttccgctggtacctcggcaaggccagcaagtgggccatcgacggcgatccggatcggcgcgccgactaccagatctggtgtggaccggccatgggctcgttcaacgcctggacgcggggctcgttcctcgcggagccggcgaaccggaccgtggtgcagattggtttgaaccttctcgagggcgcggcggtcgtcacgcgcgcccaacagctccgcacgtatggcgtgcccgttccgccgggcgcgttcgactttaggccccgcgtcctcgcctga

SEQ ID NO: 142 - protein, 543 aa, Aetherobacter; identical to SEQ ID NO: 138
  SOURCE 1..543: /mol_type="protein" /note="This sequence is generated from feature [CDS]: 1..1632 placed under sequence number 141" /organism="Aetherobacter"

SEQ ID NO: 143 - DNA, 6669 bp, Aetherobacter
  source 1..6669: /mol_type="DNA" /organism="Aetherobacter"
  CDS 1..6669: /codon_start=1 /product="domain pfa2"
atgccgcagatccccattgccatcgtgggcgtgagcgccctcttcgctggatccaccgacgcccagggtttctggcgcgacatcctcgcggggcgcgacctcatcaccgacgtgccgccgacgcactggctggtggaggattactacgatcccgatccttccgcgcccgacaagacgtactcgaagcgcggcgccttcctccccaacgtgcccttcgatcccatggagttcggcgtgccgccgagcatcgtgccggcgacggacacttcgcagctcctcgccctcatcgtcgcgcagcgcgtgctcgaggacgccacgcagggccagttcgccaagatgaaccgcgagcgcgccagcgtgatcctcggcgtcacctcgggccaagagctgctcgggacgatggtgagccggctgcaaaagccggtgtggatcaaggcgctgcgcgactccggcattccggaggacgaggcacaagccatctgcgatcgcatgtcgcgtgaatacgtgccttggcaggagtccaccttccccggcctgctgggcaacgtggtggccgggcgcatcgccaaccgcttcgatctgcgcggcaccaactgcgtcaccgacgcggcctgcgccagcgcgctctccgcggtctcgatggggatgagcgagctcgtcacggggcagtcggatctggtgatcgccggcggcgtcgacaccatgaacgacatcttcatgtacatgtgcttcagcaagacgcccgcgctctccaagagcggcgattgccggcccttctccgacgccgccgacggcacgctcctcggcgagggcatgagcatgatggcgctcaagcgtctcgccgacgccgagcgtgatggagaccgcgtttatgccgtgattcgcgggatcggatcgtcgtcggatggtcgcagcaagagcgtctatgcgccgctccccgagggccaggcgcgcgcgctccggcgcgcctacgaggtcgcgggctacgggcccgacaccgtcgagctggtcgaggcacacggcactgccacgaaagcaggcgacgccgcggagttcgagggcctccagatcgcgttcggcgaggccgggcgcacggatcggcagtggtgcgcgctcggatcggtcaaatcgcagatcgggcacaccaagtctgcggccggcgcggcgggcatgttcaaggcggtgatggcgctccatcacaaggtgctgccgccgacgatcaaggtggatcggccgaacccgaagctcgagatcgacaagagcccgttctacctcaacacccaggctcgcccgtggatccgcgatgcttcgcacccgcggcgcgcgtcggtgtcgagcttcggattcggtggcagcaacttccacctcaccatggaggagtacacggggccgggcgcgcgcgcgtcgctcctccgcagccatccggccgagctcgtgatgctcggcggcgcgagcgcgacggagctcgcagccaagtgcgcggaggccgtgaagcaggccgaggagctggggctcgccgcggtcgcgcgcacgtcgcaggagacgttccgcgcttcggatcgccatcgcctcgcggtggtggcgagcgacgcccaggatctcgcggccaagctcacgcaggcgcgcgcgaagctcgacgcggcgttctcgacgccgacggggattcattacggcatcggcgaaggcgcgggcccggtggccttcttgttcccggggcaggggagccaatacgtcggcatgggcgccgatgtcgccatgagcttcgatgcggcgcgcgccgtgtgggacgccgccgcggcgacacgcttcgatgaacttggtgtgcacgacgtggtgttcccgcggcccgtgttcaccgatgcggagcgcgaggcgcagacgaagcagctcacggcgacggagtgggcgcagcccgcgatcgggctcaccagcttggcgctgctcggcgtggtgcgcgcggtgggcgtcgcgcccgtgtgcgtgggcgggcacagcttcggcgagatcacggcgctggcggcggccggtgcgctcgatcaagcgagcgtcgtcgcggtggcgcgccgtcgcggcgagctgatgcgtgacgcgtcctcgacgccgggcgcgatgacggcggtggcgcgtcccatcgacgaggtgcgcgcgatcctcgcggagctcggcgatcgggtcgtcgtcgcgaaccacaaccatcccacgcaggtcgtgctctccggcgccgtcgacgagatcgcgcgtgtcgagcagcacctcgcgggcaagggcatcacggccaagcgcttgccggtggcgaccgcgttccacagcccgctggtggcgccgtcgtccgcgcgcttcgcggagcacctcgcggggatcccgttcgcggcgccgtccgtcgaggtgtggtccaacgcggaagcggcgccgtatggtgcggaggcggacgccattcgcggtcgcctcgccgatcagatcgcgcggccggtgcggttcgtggaggaagtcgaaggcatgtgggcccgtggggcgcgcgtcttcctcgagattgggccgggcgcggtgctcaccgaaatggtgggtcgcatcctcggcgatcggcagcacgtggcgatcgcgctggatcgcaagggcaagaatggtgtgaccagcttgcaggaggcgctcggccgcttggccgtggccggcgtggccatcgatttcgcgccgctgtgggccgggtatgcgcggccgggcgcgcccaagaagaagccggcgatgaccatccccatcaacggggccaaccacggcaagccctacccgccgccgcgcggcgcggccgccctgccgaagccgaatccgcctcgtccgaaggagatcgtgaaagtggctgcgcctccgtcctctgtctcgacgcctgtcgccgcgcccgcacccgttgcggcggctcccattgccgcgcccgcgcccattgcggtggctgcgcccattgccgcgcccgcacccattgcggcggctgcgcccatcgcggcgcgcgcgcccattgcgacggccgtgcccgtcgcggcgatgccgaacgacgcgcacctggcttgggtgcgtgcctatcaggagtcgcagcgccagacggcggaggcgcacgcggcctatctcaggacgatggccgacacgcacgcgaccttcctgcgcacggtggagtcgtcgttctcgggcctctccgcgatggtgactgggcagccgatgatgcctgtggcgcacacgacgccgagcgtccacgcggcgcccatcgcgatgttcgcggcgccgccgcccgtcgccgcgcttcccgcgccgcccattgcggtggctgcgcccgctccggcggcgtccattgcaatggctgcgccggcggcgcccattgcggtggctgcaccggtagcgcccattgcggtggctgcgccggctccggtggtcgcggcgcctgctccggtggcgcccaaggctgctgccgcgggtgtcgatctgcaggcgctgatgctgacgatcgtggcggagaagactgggtatccggtggagatgctcgggcttcagatggagctggaggcggacctcgggatcgattcgatcaagcgggtggagatcctgtcggcgatgcgggagcgcgcgccggggctgcccgaagtgaatgccagtgagatggcggcgcttcggacgctcgatcagatcgtcgagtacatgcgcgcgcgcggcgccgtcacggcaccttcggcgcctgcgccggaggcagcgcaagcggctgcaccggccgcgccttccgccgatctggaagcgttgatgctgacgatcgtggcggagaagactgggtatccggtggagatgctcgggcttcagatggagctcgaagcggacctcgggatcgattcgatcaagcgggtggagatcctgtcggcaatgcgagagcgcgcgccggggctgcccgaagtgaatgccagtgagatggcggcgcttcggacgctcgggcagatcgtcgattacatgcgtgcgcggagcggcaatgctgcgcctgcggcgcgcccgcaggcggcgagcgcaccggccgcgccggcagcggcgccgtccgtcgatctggaagcgttgatgctcacgatcgtcgcggagaagacgggctatccggtggagatgctcgggcttcagatggagctggaggcggacctcgggatcgattcgatcaagcgggtggagatcctgtcggcgatgcgggagcgcgcgccggggctgcccgaggtcaatgccagtgaaatggcggcgcttcggacgctcggacagatcgtcgagtacatgcgtgcgcggagcggcaatgcgggagcgaaggctccggcggcgccggtcgcggctgcgaccgcggaggcagcggtgcccgcggcgtctgcgattcaacgcttcgtgctgatcgaggaggcggcgacgccgtgcgggctcgccatgtcggggctgctcggggcgcgacgcgtggtggtgaccgaggacggcggtggtgtcgcagcggcggtcgtgcgcgcgctcgatgtgcgcggcgtgaaggccgaggtcgtggacacggtgagcggcgagccggacgtggtgatcttcctcggcggcctgcgcgcggtcgcgacggtggatgaagccgtcgcggtgaatcgcgaggcgttccgcgcggccaagtcgatcgcggcgcgcttcgcggcgagcggaggggtgctcgtcacggtgcaggacacgggcggcgatttcgggctctcgggtcgtgacgagcggcgggcgtggctcggtggtgtctcggcgctcgcgcgcaccgcggccatcgagtggccgagcgccgcggtgaaggcggtcgatctggagcgcggcggtcgcagcccggaggcgctcgccgaggtgctcgtgcaggagctcttcacgggcggcgcgacgcgcgaggtcgggctccatgccgatggcacgcgcacgcgcctccgcagtgtcgcgcgcgaggccgtgcctgccgcctccgtcgtggatcaagagagcgtcgtggtggtgtcgggcggtgcgcgcggcgtgacggcggcgtccgtcatcgcgctggcgcagcaggcccggccgcgcatcgtgctgctcgggcgctcgcgcctggaagaggagccggcggcgtgccgcggcgtcaccgacgacgcggggctcaagcgcgcgctgctcgaagacgccaaggcgcacggtcgcacggtcgcgcctgcggagctcggggcaggcgtcgcgcgcatccaagcgaaccgcgaggtgcaggcgacgatcgcggcgattcgcgcggcgggatccgaggtccgctacgtgccggtcgacgtgcaggatgcgcgcgggctcgcggcggcgctcgacgatgcgcggcgcacgtgggggccgatcaccggcatcgtgcacggcgccggcgtgctcgcggacaagctcatcgcggagaagaccgcggagcagttcgatcgggtcttcgatacgaaggtgctcgggctccgcgcgctgctcgacgccacggcgagcgatccgctacgcttcgtgtgcctgttctcctccgtcgcggcgcgcacgggcaacctcgggcagagcgactacgcgatggccaacgaggtgctcaacaaggtcgcggccgcgatgcgccacgcgcgcggaggatcgttcgtcgccaagtcgatcggctggggcccgtgggagggcggcatggtgacgccgtcgctcaaggcgcgcttcgatcagatgggcgtcgcgctcatcccgcttgcggatggagcgcgacgcttcgtcgcggagctctcgggctcgcccgacgaggtggagacggtggtgggcggcgccatgggcgacggcgcgctgggcgccgcggcgggatccgtcgtgtccgcggaggtcacggtggggatgcgatcgcatccgtacctcggcgatcaccgcgtcggtggcaagccggtggtgcccgtggccatggccatcgagtggatctcgcgcgccgcgcgcgcgctccgtcccgatgccggcgcggtggtgctgcgtgatctcaaggtgcttcggggcatcaagctcgatcacttcgagaacggcggcgatcggctctcgctctcgtgcaagccgcgcgcgaacggccgcgccggcgagctcaccgtcgagctgcgcgggcgcgacggcgtgctccactacagcgccaacgtcgaggccgcccgcgagccgcagcccttgccgaaccgcgcgcccgagccctcgctcggcacgtggacgcacgaggtcgtgtacgacggccacgttctcttccacggcccgagcttccaggtgattcgatccatcgacggcgtctcccgcgaaggcatcgcggggagcctcaccggcacgcgcgagcgtggttgggccgaggaagcgtggcgtgtcgatcccgcggccctcgacggtgccttgcagctcgcggtgctgtgggcgcgcgacgtcctcggtggtgcgtcgctgccgatggcggtcgcggagttcgagagcttcgtcgacggtctcccggaggcaccgatccgctgcatcgtgcgcggccgtgaagtgcacgcgcagcgcgcggtgtgcgaggtgacgctcgaggatgcgtccggtcggcccatcgcggcgctgcgcggcgtggagaccatccttcgtccgggggagcagcccggccggaccgccgcgcaggcgggcgcggcctcgtga

SEQ ID NO: 144 - protein, 2222 aa, Aetherobacter; identical to SEQ ID NO: 139
  SOURCE 1..2222: /mol_type="protein" /note="This sequence is generated from feature [CDS]: 1..6669 placed under sequence number 143" /organism="Aetherobacter"

SEQ ID NO: 145 - DNA, 8868 bp, Aetherobacter
  source 1..8868: /mol_type="DNA" /organism="Aetherobacter"
  CDS 1..8868: /codon_start=1 /product="domain pfa3"
gtgaggttcgagccgatcgccatcgtcggcgagggctgcgtcctgccgggcgcggcctcgccgtccgcgctccgcgaggccgtgctcgcggggcgcaacgcggtcacgggcgtgcccgacggacgctggcgactccccgccgcgcactccatgggcacgcccgatcacgcggtggatcgcgcctggtccgacgccggcggatacgtggagggcttcgagcccagcttcgatccgaccggcttccatctgtctgcagaccgcgtgcgcgcgctcgattcctcgttccgttgggtgctccacgccgctcgccaagcgctcgcattcgccggcgcctcgcgggcctcggcgcgcgccgggctcgtgctcggcaacctctcgttcccgacggcgacgatgacgcgcttcgccgagagcgtgtggctcgacgcgcagggcgaggcgttcctcggcggccgcgcgcgtgcgctcgcgggcgtcgatcgacccgatccgcaaaaccgcttcatgtccggcttccccgtgcagctcgcggccgaagccctcggcctcggcgcgggtggcttcgcgctcgacgcggcctgcgcctcgtcgctctacgccatcaagctcgcgtgtgatcgcctccacgatcgctcggccgatctcatgctcgcgggcgccgtcaacgccgcggacaacctcttcctccacgtcggcttctgcgcgctcgcggccatgagccgcacgggccagagccgcccgttccatcgcgatgccgacgggctcgtgcccgccgaaggcgccgccgtcgtcgcgctcaagcggctcgccgatgcgcgcgacgcgggcgatcgcatcctcggtgtgatccgcggcgtcggcctctccaacgacggtcgcggtcgcggcctcctcgcgcccgcggaggaagggcagatccgcgccatgcgcgcggcctacgcgatgtcgggcctcacgcccgcgcacgtctcgctcgtcgagtgtcacgccaccggcacgcccgtgggcgacgccaccgaggtgcgctcgatgaccgcgctcttcgaaggcctgcgcgacgtgcccatcggctcgctcaaatcgaacctcggccacctcatcacggtggccggcgtcgctggtctcatgaaggtgctcggcgccttcgcggccggcctgcggcctcccacgctgcacgccgacgcgcccatcgacgcgctccgcggctccccgttccgcttgctgacgagcgccgaggaatggcccgccaacggcccgcgcgtcgcggccgtcagcgccttcggcttcggtggcaacaacgcgcatctcctcgtcaccgaggacgatgccggcgcctccgtgacctcgttcgtccccgcatctcccgcgccgcccatcgccgtcgtcggcatcggcgccatgctcggcgacaccacgggcgcggatgccgccgcgcgcgccgtgctctccggcgagcgctggaatccgcggcgcaccgacgtcaccgtcgcgctcgaagggctgcgcgtcccgcctcgcgatctcgagcagacgcttccccaacagctcctcgcgctcgaagccgcgcgcgaagccgtgcggggcatcacgctcccgcgcgagcgcaccggcgtgctcgtcggcatgggctgcgatcccgagatcgcccgctacggcacgcgctggcgcctcgcggattgggcggacacctgggcctctcgcgaaggcaaggtcgtctccgacgattggctctcccgcgcccgcgatgccgtgcagaccaagctccaggccgcgggcgtcgtggggacgatgcccaacatccccgcgaaccgcatcaacagccagctcgatctcgccggcctcggctacaccgtctccgccgagcaggcctcgggcattgtcgccttggagatcgccgcgcgcgcgctgcgtgaaggcgagctcgacgccgccgtcgtgggcgccgtcgatctctcggacgagcccgtgcaccgcgccgcgctcggccccgacgcgaagcccggcgatgccgccgtcgtgctcgtcctcaagcgtctcgacgacgcgcgtcgcgacggcgatcgcgtcctcgccctcctcgacggcgacggccccgccacgctccgcatcggcgacggcggcatcgatccttccgcgcatgcgaccgcgcacgccgccgccggcctcgttcacgtcgccaccgccatctggagcgtctttcacggcgcgcgccccgccgatggacgcgccgccacaccgtggctcggcacccgcagcgccgagaccgtgacacgctcgctcgccggcgcgcccaccaccgtgcgcatcgcgtccgccgcgccgccggccccgctcgccttcgagcctccgccgcgcctccacgtgatcgccggcgccgatcgcgccgccgtgatccgcgcgctctccggtggccccatctccaccgaaggcccggcccgcctcgtcatcgtcgccgcgaccgacgaagagcgcacgacccgtctcgcacaggccaaacgctacctcgaaaaaggcggccccgcgcccgagggcatcgcctaccgcgacgcgcccctcgccggcgatctcgccttcgtcttcaccggcgccgccgcttcctacgttggcatgggccgcgagctcgcgctcgcattgccctccgccgtcacgcgcctcggcgcgcgcttcgcgaccctcgcggacgcgacccgttggatcttcggcccgcccgccgcgcccaatcacccgctcgagcagctctgggcgagcgccttcctctgccagctccacgtggagatctcgcgcggcatcctgggcctcacgccgcaggcgaccattggttattcgtccggcgagagcaatgctctcttcgcttcgggcgcctggcgcgatctcgacgccatggtcgccgaatcgtggaagagccccattttcaccgacggcatcgtcggcgacttcaccgccgcgcgtcgcgcctggcgcaagctcggcagcgacggcacgtgggaggcatggagtgtcgccgcccccgtcgaagccgtccgcgaagcgctccgcggcgagcccacggcgcacctgaccatcatcaacacccccgaggactgcgtgatcggcggcgaggcctccgccgtcggccgtgtcctcgacaagctcggtcgctcccgcgcgctcccgctcgactacgaaatggccgcgcattgcccggagatcgaagagatccgaaaggagtggtacgacctccatcaccgcgccacgtcggacgttcccgacatccgcgtctactccgccggcagcgcgaccgccttccaagccacctcggatcgcgcggcggcggccatcactgcgcaggccgtgggcacgctcgatttcccccgcatgatcgagcgcgcctatgccgacggcgtccgcatcttcgtggagcacggcccgcgcggcctctgcagtggttgggtcaaacgcatcctcggtgaccgcgagcacctcgccgtttcactcgacgtcgccggcaggagcggtgtccgccagctcgccaatgccgcagctgccttggtcgccgcgggcgtccccgtcgacaccgacgcgctccattccgcgctcggcgaaggcgcgcgcatcgataagcccaccggcgccaccatgcgaatccccgcccatccgccggccattcaactccctccattcgagtcttccgtgcaagtgatggtgcccgcgcctccgctcccgcccgtgttggagcaaccgctctccgccgcgatcccggtgcctcgtcccgagagccccaaagcctcctcgccgacaccgcatctcgcgacacccaccgtgaccgccccgccgccggtgcccctcgcggccgcgcctctgcctgccgcgacaacccttctcccggccccggcggcacccgagctcacggtcacgccatctcccacggtggagatcctggcccgcgccacacaacaacacgccctcctcggcgccattcatcgcgacttcctggaagcccaggccgcggcgcacacccagttcctcgcgctccagcaaaccatgctggccggcttgatgagggcctattcgagcgccccgccgagccccgccgtcgagctcctcgagcacccggtcaccgtctctcaggtcctcccggatcctgtgcaaattcaacagcctgcaccggactcggcacctcccgcgaccccgctccgcgcggcgccgcccccgagcgctctgcctcgtccggcagccgtctcgccgcctccgagcattctgcctctcccggccgccgccgcgccgccggtgtccctctcgcgccccgccccggtcgcgaaagccacgctccccggccccaagtacgatagggctcagctcgaggtcctcgcctccggcaacatctcttccgtcttcggcccagccttcgccgatcaggatggcttccaccgccaagtccgcatgcccatgccgccgctccttttggcggatcgggtgacgggcatcgccggtgagcatcacgcggtggggactggcaccatctggacggagacggacgtcaccaccgagagttggtatctccacgagggccgcatgcccgcggggatcatgatcgagtcgggtcaagccgatctcctcctcatctcctggcagggcgccgaccgccagaatcgcagcgagcgtgtctatcgcctcctcggctgcgacctcacgtatcacggcgagctgcccaagccgggcgacacgctcgtttacgacatccacatcgatggccacgcccgccagggcgacattcgtctcttcttcttccactacgattgtcgcatcaatggtgagctgcgcctctcggtgcgcagcggccaggccggcttcttcaccgaggccgagctcgccgactccggcggcatcctctgggacgcgcagacgggtgagcaccgcaccacgggcccgctcgatcctcccgccgtcgcttgcgccaaacgcagcttcacggagaccgaagtccgcgccttcgccgacggacgcgtggtcgattgtttcggccccggcttcgaaaagaccctcgcccacgtgcgcacgccgcgcatccagtccgagcgcatgctcttcctccgcgaggtcgtcgagttcgatccgcgcggcgggccttggggacgcggatacctgcgcgccgaagcgcccatcacgcccgatgattggtatttcacggggcacttcctcaacgacccttgcatgcctggaactctgatgttcgagggctgcgtgcaggccatgtcgttctacctcgtggccatgggcttctccgtcgatcgcgacggctggcgcttcgagcccgtcgccggccacaagatccccatgcgctgccgcgggcaggtcatcccgagctcgaagcgcctcacctacgaagtcttcgtcgaagaggtgattgcggggccagtgcccaccgtctatgccgatctcctctgcaccgtggatggcctcaaggcctttcacgcgcggcgtgtcggcctcaagctcgtccccgattggccgctcgccgattgggctcatcttcccgtcgcctccgccgcggatccggcccatcgcaccatggatcagcggaagctcggcggtctcgccggctgggtggagccgaagccggtggcctcgcacgagggcttcccgttcgattatccctcgctcctcgcctgcgcctgggggcgcccgtcggcggcgttcgggcccatgtatgcgcccttcgacggcccgcgcaacgtggcccgtttgcccgggccgccctatcacttcatgtcacgcatcacccgcacggacgcgcccatgggcgccttccgcgcgggcgcatcgatcgaggccgaatacgatgtcccgaaggaggcgtggtatttcgatctcaacgggcaccccaccatgcccttctgcgtgctcatggaggccgcgctccagccttgtggttggctcgcgagctacatcgggagcacgctcaccgccgacatcgatctcatgttccgcaacctcgatggaacggggacgttgctcgcggaggtcctgcccacctcgggcaccctgcgcacgcgcgccaaggtgacggacgtctcccgctcggcggggatgatcatcgagtcgttcgaggtcgagtgcttcgtcggcgacacctgcgtttacaagatgaagaccgtcttcgggttcttccccaaagaggccttcgaaaaccaggtgggtttgcccgtcaccccggaggagcgcgcccgcctcgaggctccctcctcgtatctcgtcgatctgcggagccgcccgtcacgctacttcgaggcctcgccccgcctgcccgagcccatgctctgcatgctcgatcgcgtcaccgcgtgggtgcccgagggcggcaaaaaggggctcggttgggcccgcggcgagaaggacgtcgatgcgagcgagtggttcttcaaagcccacttcttccaagatcccgtgcaacccgggtcgctcggcatcgaggcgctcgtccagctcctgcaattcgccatgatggagcggggcatggccgagggcgtgcccggcgcgcgcttcgagccggtcgcggtgggcaagccttccgtctggaaataccgcggtcaggtggtgccctcgaatcgccgcatcaccaccgagatcgacatcctcgaagtcggtgaggacgagcgcggtcgcttcgcggtggcggaaggctcgttgtgggtcgacggcaaacgcatctaccacaccaagtctctcgccatgcgcatcgtccccggcggcgcgcccccgcgcgggcctcgtgtcgggcaaccgcgtgaggaaacgctcgatgccgcggtcgacacgtggctcggcgatcatcggcccacgtggacgctgcccgcgctgccgatgatgtcgatggtcgatcgcctcgccgcggccgcgcagccttcgccgagcgggcgcgtcgtggagatcgccgacgtgcaagtgaagcgctggctcccgttcccgggcggccccgtgcgtctcaccacggaggtgaatcatcgcgacgacggagagcacgtcaccctgctcgccttccgcgaagcgcgtgacgccgcgctctcgcgcttcgagcccgtggccacgggccgcgtgcgtctcgcgccgcgtttcccggcgccgcccgcgcccttcgcgccgctcgcggacgccgcgcccatcgacgatccgtatgcctcgggcgcgctgttccacggcccctcgttccagatgctgcggtctctgcgcttcgggtccaaaggcgcttccgccatcctcgacatggccgagcgcggcgtcccccgcggggcgcttcatcaaggcctcctcgacgcgctcacccacgccattccccacgacgatctctcccggtggtcgcccgacatcgaaggcgatcaggtgggctatccctaccgcattccctcgattcgtttcttcggcgaaatgccttctgcgggagaaggccaattggaggtgcgcttcgccggcttcgacggacaaccgcgcttcccgaaattcgaggtccagctcctcgtcggcggcgtggtgcgcgtcgccctcacgctcgtcgaagtgctcctcccgcgcggccccatcggacagcggagccgcgcggatcgccgcgcgttcctgcgcgatcggcgcttcgtgccgggcgtgcgcctctcgcgcgccgagggcgccctcaccgtggctgcccccgaggacgtgaagccgagcgattggctccctggcaacgtcgcctgcatctatggagtcgccccgggcgccgatctcgtggccgaagtcgcggtgcgcgatcacctcgcccaacgtgccttcgtgcacccgagcaccgtgcgcccgagcgcggacctcgccgacgccacggtggccatgcggcctttgcgccggcatttcctcgacgtgcggcgcgacggcgacacggtgcgcgtctccgatgctcgcccgccggccatggacctcggcccggtggaagcgcattggcgcaagtggttcggcatcggcgcctggccggtggaggacctttattacggcctcatcgagcgcttcgtcggcgacgtggtgatcgccgatcccgaggccttcgccaaggtgcgcgggcggagctgcctttacctcgccaatcaccaggtcgcggtggagtcgctcctgttctcggtgctcgtctcggcgctctcgggcgtctccacgatcacgctggccaaggccgagcaccgggcctcgtgggtgggcgagctcatccggcagagcttcagttatcccggcatcaccgatcccggcctcatcacgttcttcgatcgcgaagatcgagagtccttgatgcgcatcatcggcgacctcgccgccgaaatggcccaacagggcaagagcgccatggtgcacgtcgaaggcacgcgctccctctcgtgccggcacccggtggtgaagatgagctccgcgttcatcgacatggcgctcgccgtgggcgcgcccatcgtgcccgtgcgtttcgtgggcggtttgccggccgaagagctctcgcaacgcatcgagttccccgtcggccacggtcgccaagacttctggctcggccgccccgtgctcccggaagagctgcgcgccctgccgctcaaagagcgcaagcaagtcgtgatcgacgccatcaatggcctcggtcccggcccgcagcacgaggagcctcatccgggggacaccgcgttcaccgcgcgcgtcgagtcctggaagccgcgcaccggcggcaacgcggagcgcgccacgctgctcgcgaccctggaggcgctgccggcccatcgctccgaagcgacggggaggctcgtcgagagcgcccgcgaagggcgttcgagctttggtgcggagccgagcgagcaatggctctctgggtttgcgcgctggctcttgggtggctga

SEQ ID NO: 146 - protein, 2955 aa, Aetherobacter; identical to SEQ ID NO: 140
  SOURCE 1..2955: /mol_type="protein" /note="This sequence is generated from feature [CDS]: 1..8868 placed under sequence number 145" /organism="Aetherobacter"

SEQ ID NO: 147 - DNA, 1632 bp, Aetherobacter; identical to SEQ ID NO: 141
  source 1..1632: /mol_type="DNA" /organism="Aetherobacter"
  CDS 1..1632: /codon_start=1 /product="domain I" /transl_table=11

SEQ ID NO: 148 - protein, 543 aa, Aetherobacter; identical to SEQ ID NO: 138
  SOURCE 1..543: /mol_type="protein" /note="This sequence is generated from feature [CDS]: 1..1632 placed under sequence number 147" /organism="Aetherobacter"

SEQ ID NO: 149 - protein, 543 aa, Aetherobacter; identical to SEQ ID NO: 138
  DOMAIN 1..543
  SOURCE 1..543: /mol_type="protein" /organism="Aetherobacter"

SEQ ID NO: 150 - DNA, 3492 bp, Aetherobacter
  source 1..3492: /mol_type="DNA" /organism="Aetherobacter"
  CDS 1..3492: /codon_start=1 /gene="domain IIa" /transl_table=11
atgccgcagatccccattgccatcgtgggcgtgagcgccctcttcgctggatccaccgacgcccagggtttctggcgcgacatcctcgcggggcgcgacctcatcaccgacgtgccgccgacgcactggctggtggaggattactacgatcccgatccttccgcgcccgacaagacgtactcgaagcgcggcgccttcctccccaacgtgcccttcgatcccatggagttcggcgtgccgccgagcatcgtgccggcgacggacacttcgcagctcctcgccctcatcgtcgcgcagcgcgtgctcgaggacgccacgcagggccagttcgccaagatgaaccgcgagcgcgccagcgtgatcctcggcgtcacctcgggccaagagctgctcgggacgatggtgagccggctgcaaaagccggtgtggatcaaggcgctgcgcgactccggcattccggaggacgaggcacaagccatctgcgatcgcatgtcgcgtgaatacgtgccttggcaggagtccaccttccccggcctgctgggcaacgtggtggccgggcgcatcgccaaccgcttcgatctgcgcggcaccaactgcgtcaccgacgcggcctgcgccagcgcgctctccgcggtctcgatggggatgagcgagctcgtcacggggcagtcggatctggtgatcgccggcggcgtcgacaccatgaacgacatcttcatgtacatgtgcttcagcaagacgcccgcgctctccaagagcggcgattgccggcccttctccgacgccgccgacggcacgctcctcggcgagggcatgagcatgatggcgctcaagcgtctcgccgacgccgagcgtgatggagaccgcgtttatgccgtgattcgcgggatcggatcgtcgtcggatggtcgcagcaagagcgtctatgcgccgctccccgagggccaggcgcgcgcgctccggcgcgcctacgaggtcgcgggctacgggcccgacaccgtcgagctggtcgaggcacacggcactgccacgaaagcaggcgacgccgcggagttcgagggcctccagatcgcgttcggcgaggccgggcgcacggatcggcagtggtgcgcgctcggatcggtcaaatcgcagatcgggcacaccaagtctgcggccggcgcggcgggcatgttcaaggcggtgatggcgctccatcacaaggtgctgccgccgacgatcaaggtggatcggccgaacccgaagctcgagatcgacaagagcccgttctacctcaacacccaggctcgcccgtggatccgcgatgcttcgcacccgcggcgcgcgtcggtgtcgagcttcggattcggtggcagcaacttccacctcaccatggaggagtacacggggccgggcgcgcgcgcgtcgctcctccgcagccatccggccgagctcgtgatgctcggcggcgcgagcgcgacggagctcgcagccaagtgcgcggaggccgtgaagcaggccgaggagctggggctcgccgcggtcgcgcgcacgtcgcaggagacgttccgcgcttcggatcgccatcgcctcgcggtggtggcgagcgacgcccaggatctcgcggccaagctcacgcaggcgcgcgcgaagctcgacgcggcgttctcgacgccgacggggattcattacggcatcggcgaaggcgcgggcccggtggccttcttgttcccggggcaggggagccaatacgtcggcatgggcgccgatgtcgccatgagcttcgatgcggcgcgcgccgtgtgggacgccgccgcggcgacacgcttcgatgaacttggtgtgcacgacgtggtgttcccgcggcccgtgttcaccgatgcggagcgcgaggcgcagacgaagcagctcacggcgacggagtgggcgcagcccgcgatcgggctcaccagcttggcgctgctcggcgtggtgcgcgcggtgggcgtcgcgcccgtgtgcgtgggcgggcacagcttcggcgagatcacggcgctggcggcggccggtgcgctcgatcaagcgagcgtcgtcgcggtggcgcgccgtcgcggcgagctgatgcgtgacgcgtcctcgacgccgggcgcgatgacggcggtggcgcgtcccatcgacgaggtgcgcgcgatcctcgcggagctcggcgatcgggtcgtcgtcgcgaaccacaaccatcccacgcaggtcgtgctctccggcgccgtcgacgagatcgcgcgtgtcgagcagcacctcgcgggcaagggcatcacggccaagcgcttgccggtggcgaccgcgttccacagcccgctggtggcgccgtcgtccgcgcgcttcgcggagcacctcgcggggatcccgttcgcggcgccgtccgtcgaggtgtggtccaacgcggaagcggcgccgtatggtgcggaggcggacgccattcgcggtcgcctcgccgatcagatcgcgcggccggtgcggttcgtggaggaagtcgaaggcatgtgggcccgtggggcgcgcgtcttcctcgagattgggccgggcgcggtgctcaccgaaatggtgggtcgcatcctcggcgatcggcagcacgtggcgatcgcgctggatcgcaagggcaagaatggtgtgaccagcttgcaggaggcgctcggccgcttggccgtggccggcgtggccatcgatttcgcgccgctgtgggccgggtatgcgcggccgggcgcgcccaagaagaagccggcgatgaccatccccatcaacggggccaaccacggcaagccctacccgccgccgcgcggcgcggccgccctgccgaagccgaatccgcctcgtccgaaggagatcgtgaaagtggctgcgcctccgtcctctgtctcgacgcctgtcgccgcgcccgcacccgttgcggcggctcccattgccgcgcccgcgcccattgcggtggctgcgcccattgccgcgcccgcacccattgcggcggctgcgcccatcgcggcgcgcgcgcccattgcgacggccgtgcccgtcgcggcgatgccgaacgacgcgcacctggcttgggtgcgtgcctatcaggagtcgcagcgccagacggcggaggcgcacgcggcctatctcaggacgatggccgacacgcacgcgaccttcctgcgcacggtggagtcgtcgttctcgggcctctccgcgatggtgactgggcagccgatgatgcctgtggcgcacacgacgccgagcgtccacgcggcgcccatcgcgatgttcgcggcgccgccgcccgtcgccgcgcttcccgcgccgcccattgcggtggctgcgcccgctccggcggcgtccattgcaatggctgcgccggcggcgcccattgcggtggctgcaccggtagcgcccattgcggtggctgcgccggctccggtggtcgcggcgcctgctccggtggcgcccaaggctgctgccgcgggtgtcgatctgcaggcgctgatgctgacgatcgtggcg

SEQ ID NO: 151 - protein, 1164 aa, Aetherobacter
  SOURCE 1..1164: /mol_type="protein" /note="This sequence is generated from feature [CDS]: 1..3492 placed under sequence number 150" /organism="Aetherobacter"
MPQIPIAIVGVSALFAGSTDAQGFWRDILAGRDLITDVPPTHWLVEDYYDPDPSAPDKTYSKRGAFLPNVPFDPMEFGVPPSIVPATDTSQLLALIVAQRVLEDATQGQFAKMNRERASVILGVTSGQELLGTMVSRLQKPVWIKALRDSGIPEDEAQAICDRMSREYVPWQESTFPGLLGNVVAGRIANRFDLRGTNCVTDAACASALSAVSMGMSELVTGQSDLVIAGGVDTMNDIFMYMCFSKTPALSKSGDCRPFSDAADGTLLGEGMSMMALKRLADAERDGDRVYAVIRGIGSSSDGRSKSVYAPLPEGQARALRRAYEVAGYGPDTVELVEAHGTATKAGDAAEFEGLQIAFGEAGRTDRQWCALGSVKSQIGHTKSAAGAAGMFKAVMALHHKVLPPTIKVDRPNPKLEIDKSPFYLNTQARPWIRDASHPRRASVSSFGFGGSNFHLTMEEYTGPGARASLLRSHPAELVMLGGASATELAAKCAEAVKQAEELGLAAVARTSQETFRASDRHRLAVVASDAQDLAAKLTQARAKLDAAFSTPTGIHYGIGEGAGPVAFLFPGQGSQYVGMGADVAMSFDAARAVWDAAAATRFDELGVHDVVFPRPVFTDAEREAQTKQLTATEWAQPAIGLTSLALLGVVRAVGVAPVCVGGHSFGEITALAAAGALDQASVVAVARRRGELMRDASSTPGAMTAVARPIDEVRAILAELGDRVVVANHNHPTQVVLSGAVDEIARVEQHLAGKGITAKRLPVATAFHSPLVAPSSARFAEHLAGIPFAAPSVEVWSNAEAAPYGAEADAIRGRLADQIARPVRFVEEVEGMWARGARVFLEIGPGAVLTEMVGRILGDRQHVAIALDRKGKNGVTSLQEALGRLAVAGVAIDFAPLWAGYARPGAPKKKPAMTIPINGANHGKPYPPPRGAAALPKPNPPRPKEIVKVAAPPSSVSTPVAAPAPVAAAPIAAPAPIAVAAPIAAPAPIAAAAPIAARAPIATAVPVAAMPNDAHLAWVRAYQESQRQTAEAHAAYLRTMADTHATFLRTVESSFSGLSAMVTGQPMMPVAHTTPSVHAAPIAMFAAPPPVAALPAPPIAVAAPAPAASIAMAAPAAPIAVAAPVAPIAVAAPAPVVAAPAPVAPKAAAAGVDLQALMLTIVA

SEQ ID NO: 152 - protein, 1164 aa, Aetherobacter; identical to SEQ ID NO: 151
  DOMAIN 1..1164: "domain IIa"
  SOURCE 1..1164: /mol_type="protein" /organism="Aetherobacter"

SEQ ID NO: 153 - DNA, 771 bp, Aetherobacter
  source 1..771: /mol_type="DNA" /organism="Aetherobacter"
  CDS 1..771: /codon_start=1 /gene="domain IIb" /transl_table=11
gagaagactgggtatccggtggagatgctcgggcttcagatggagctggaggcggacctcgggatcgattcgatcaagcgggtggagatcctgtcggcgatgcgggagcgcgcgccggggctgcccgaagtgaatgccagtgagatggcggcgcttcggacgctcgatcagatcgtcgagtacatgcgcgcgcgcggcgccgtcacggcaccttcggcgcctgcgccggaggcagcgcaagcggctgcaccggccgcgccttccgccgatctggaagcgttgatgctgacgatcgtggcggagaagactgggtatccggtggagatgctcgggcttcagatggagctcgaagcggacctcgggatcgattcgatcaagcgggtggagatcctgtcggcaatgcgagagcgcgcgccggggctgcccgaagtgaatgccagtgagatggcggcgcttcggacgctcgggcagatcgtcgattacatgcgtgcgcggagcggcaatgctgcgcctgcggcgcgcccgcaggcggcgagcgcaccggccgcgccggcagcggcgccgtccgtcgatctggaagcgttgatgctcacgatcgtcgcggagaagacgggctatccggtggagatgctcgggcttcagatggagctggaggcggacctcgggatcgattcgatcaagcgggtggagatcctgtcggcgatgcgggagcgcgcgccggggctgcccgaggtcaatgccagtgaaatggcggcgcttcggacgctcgga

SEQ ID NO: 154 - protein, 257 aa, Aetherobacter
  SOURCE 1..257: /mol_type="protein" /note="This sequence is generated from feature [CDS]: 1..771 placed under sequence number 153" /organism="Aetherobacter"
EKTGYPVEMLGLQMELEADLGIDSIKRVEILSAMRERAPGLPEVNASEMAALRTLDQIVEYMRARGAVTAPSAPAPEAAQAAAPAAPSADLEALMLTIVAEKTGYPVEMLGLQMELEADLGIDSIKRVEILSAMRERAPGLPEVNASEMAALRTLGQIVDYMRARSGNAAPAARPQAASAPAAPAAAPSVDLEALMLTIVAEKTGYPVEMLGLQMELEADLGIDSIKRVEILSAMRERAPGLPEVNASEMAALRTLG

SEQ ID NO: 155 - protein, 257 aa, Aetherobacter; identical to SEQ ID NO: 154
  DOMAIN 1..257
  SOURCE 1..257: /mol_type="protein" /organism="Aetherobacter"

SEQ ID NO: 156 - DNA, 2406 bp, Aetherobacter
  source 1..2406: /mol_type="DNA" /organism="Aetherobacter"
  CDS 1..2406: /codon_start=1 /gene="domain IIc" /transl_table=11
cagatcgtcgagtacatgcgtgcgcggagcggcaatgcgggagcgaaggctccggcggcgccggtcgcggctgcgaccgcggaggcagcggtgcccgcggcgtctgcgattcaacgcttcgtgctgatcgaggaggcggcgacgccgtgcgggctcgccatgtcggggctgctcggggcgcgacgcgtggtggtgaccgaggacggcggtggtgtcgcagcggcggtcgtgcgcgcgctcgatgtgcgcggcgtgaaggccgaggtcgtggacacggtgagcggcgagccggacgtggtgatcttcctcggcggcctgcgcgcggtcgcgacggtggatgaagccgtcgcggtgaatcgcgaggcgttccgcgcggccaagtcgatcgcggcgcgcttcgcggcgagcggaggggtgctcgtcacggtgcaggacacgggcggcgatttcgggctctcgggtcgtgacgagcggcgggcgtggctcggtggtgtctcggcgctcgcgcgcaccgcggccatcgagtggccgagcgccgcggtgaaggcggtcgatctggagcgcggcggtcgcagcccggaggcgctcgccgaggtgctcgtgcaggagctcttcacgggcggcgcgacgcgcgaggtcgggctccatgccgatggcacgcgcacgcgcctccgcagtgtcgcgcgcgaggccgtgcctgccgcctccgtcgtggatcaagagagcgtcgtggtggtgtcgggcggtgcgcgcggcgtgacggcggcgtccgtcatcgcgctggcgcagcaggcccggccgcgcatcgtgctgctcgggcgctcgcgcctggaagaggagccggcggcgtgccgcggcgtcaccgacgacgcggggctcaagcgcgcgctgctcgaagacgccaaggcgcacggtcgcacggtcgcgcctgcggagctcggggcaggcgtcgcgcgcatccaagcgaaccgcgaggtgcaggcgacgatcgcggcgattcgcgcggcgggatccgaggtccgctacgtgccggtcgacgtgcaggatgcgcgcgggctcgcggcggcgctcgacgatgcgcggcgcacgtgggggccgatcaccggcatcgtgcacggcgccggcgtgctcgcggacaagctcatcgcggagaagaccgcggagcagttcgatcgggtcttcgatacgaaggtgctcgggctccgcgcgctgctcgacgccacggcgagcgatccgctacgcttcgtgtgcctgttctcctccgtcgcggcgcgcacgggcaacctcgggcagagcgactacgcgatggccaacgaggtgctcaacaaggtcgcggccgcgatgcgccacgcgcgcggaggatcgttcgtcgccaagtcgatcggctggggcccgtgggagggcggcatggtgacgccgtcgctcaaggcgcgcttcgatcagatgggcgtcgcgctcatcccgcttgcggatggagcgcgacgcttcgtcgcggagctctcgggctcgcccgacgaggtggagacggtggtgggcggcgccatgggcgacggcgcgctgggcgccgcggcgggatccgtcgtgtccgcggaggtcacggtggggatgcgatcgcatccgtacctcggcgatcaccgcgtcggtggcaagccggtggtgcccgtggccatggccatcgagtggatctcgcgcgccgcgcgcgcgctccgtcccgatgccggcgcggtggtgctgcgtgatctcaaggtgcttcggggcatcaagctcgatcacttcgagaacggcggcgatcggctctcgctctcgtgcaagccgcgcgcgaacggccgcgccggcgagctcaccgtcgagctgcgcgggcgcgacggcgtgctccactacagcgccaacgtcgaggccgcccgcgagccgcagcccttgccgaaccgcgcgcccgagccctcgctcggcacgtggacgcacgaggtcgtgtacgacggccacgttctcttccacggcccgagcttccaggtgattcgatccatcgacggcgtctcccgcgaaggcatcgcggggagcctcaccggcacgcgcgagcgtggttgggccgaggaagcgtggcgtgtcgatcccgcggccctcgacggtgccttgcagctcgcggtgctgtgggcgcgcgacgtcctcggtggtgcgtcgctgccgatggcggtcgcggagttcgagagcttcgtcgacggtctcccggaggcaccgatccgctgcatcgtgcgcggccgtgaagtgcacgcgcagcgcgcggtgtgcgaggtgacgctcgaggatgcgtccggtcggcccatcgcggcgctgcgcggcgtggagaccatccttcgtccgggggagcagcccggccggaccgccgcgcaggcgggcgcggcctcgtga

SEQ ID NO: 157 - protein, 801 aa, Aetherobacter
  SOURCE 1..801: /mol_type="protein" /note="This sequence is generated from feature [CDS]: 1..2406 placed under sequence number 156" /organism="Aetherobacter"
QIVEYMRARSGNAGAKAPAAPVAAATAEAAVPAASAIQRFVLIEEAATPCGLAMSGLLGARRVVVTEDGGGVAAAVVRALDVRGVKAEVVDTVSGEPDVVIFLGGLRAVATVDEAVAVNREAFRAAKSIAARFAASGGVLVTVQDTGGDFGLSGRDERRAWLGGVSALARTAAIEWPSAAVKAVDLERGGRSPEALAEVLVQELFTGGATREVGLHADGTRTRLRSVAREAVPAASVVDQESVVVVSGGARGVTAASVIALAQQARPRIVLLGRSRLEEEPAACRGVTDDAGLKRALLEDAKAHGRTVAPAELGAGVARIQANREVQATIAAIRAAGSEVRYVPVDVQDARGLAAALDDARRTWGPITGIVHGAGVLADKLIAEKTAEQFDRVFDTKVLGLRALLDATASDPLRFVCLFSSVAARTGNLGQSDYAMANEVLNKVAAAMRHARGGSFVAKSIGWGPWEGGMVTPSLKARFDQMGVALIPLADGARRFVAELSGSPDEVETVVGGAMGDGALGAAAGSVVSAEVTVGMRSHPYLGDHRVGGKPVVPVAMAIEWISRAARALRPDAGAVVLRDLKVLRGIKLDHFENGGDRLSLSCKPRANGRAGELTVELRGRDGVLHYSANVEAAREPQPLPNRAPEPSLGTWTHEVVYDGHVLFHGPSFQVIRSIDGVSREGIAGSLTGTRERGWAEEAWRVDPAALDGALQLAVLWARDVLGGASLPMAVAEFESFVDGLPEAPIRCIVRGREVHAQRAVCEVTLEDASGRPIAALRGVETILRPGEQPGRTAAQAGAAS

SEQ ID NO: 158 - protein, 801 aa, Aetherobacter; identical to SEQ ID NO: 157
  DOMAIN 1..158: "domain IIc"
  SOURCE 1..801: /mol_type="protein" /organism="Aetherobacter"

SEQ ID NO: 159 - DNA, 2574 bp, Aetherobacter
  source 1..2574: /mol_type="DNA" /organism="Aetherobacter"
  CDS 1..2574: /codon_start=1 /gene="domain IIIa" /transl_table=11
gtgaggttcgagccgatcgccatcgtcggcgagggctgcgtcctgccgggcgcggcctcgccgtccgcgctccgcgaggccgtgctcgcggggcgcaacgcggtcacgggcgtgcccgacggacgctggcgactccccgccgcgcactccatgggcacgcccgatcacgcggtggatcgcgcctggtccgacgccggcggatacgtggagggcttcgagcccagcttcgatccgaccggcttccatctgtctgcagaccgcgtgcgcgcgctcgattcctcgttccgttgggtgctccacgccgctcgccaagcgctcgcattcgccggcgcctcgcgggcctcggcgcgcgccgggctcgtgctcggcaacctctcgttcccgacggcgacgatgacgcgcttcgccgagagcgtgtggctcgacgcgcagggcgaggcgttcctcggcggccgcgcgcgtgcgctcgcgggcgtcgatcgacccgatccgcaaaaccgcttcatgtccggcttccccgtgcagctcgcggccgaagccctcggcctcggcgcgggtggcttcgcgctcgacgcggcctgcgcctcgtcgctctacgccatcaagctcgcgtgtgatcgcctccacgatcgctcggccgatctcatgctcgcgggcgccgtcaacgccgcggacaacctcttcctccacgtcggcttctgcgcgctcgcggccatgagccgcacgggccagagccgcccgttccatcgcgatgccgacgggctcgtgcccgccgaaggcgccgccgtcgtcgcgctcaagcggctcgccgatgcgcgcgacgcgggcgatcgcatcctcggtgtgatccgcggcgtcggcctctccaacgacggtcgcggtcgcggcctcctcgcgcccgcggaggaagggcagatccgcgccatgcgcgcggcctacgcgatgtcgggcctcacgcccgcgcacgtctcgctcgtcgagtgtcacgccaccggcacgcccgtgggcgacgccaccgaggtgcgctcgatgaccgcgctcttcgaaggcctgcgcgacgtgcccatcggctcgctcaaatcgaacctcggccacctcatcacggtggccggcgtcgctggtctcatgaaggtgctcggcgccttcgcggccggcctgcggcctcccacgctgcacgccgacgcgcccatcgacgcgctccgcggctccccgttccgcttgctgacgagcgccgaggaatggcccgccaacggcccgcgcgtcgcggccgtcagcgccttcggcttcggtggcaacaacgcgcatctcctcgtcaccgaggacgatgccggcgcctccgtgacctcgttcgtccccgcatctcccgcgccgcccatcgccgtcgtcggcatcggcgccatgctcggcgacaccacgggcgcggatgccgccgcgcgcgccgtgctctccggcgagcgctggaatccgcggcgcaccgacgtcaccgtcgcgctcgaagggctgcgcgtcccgcctcgcgatctcgagcagacgcttccccaacagctcctcgcgctcgaagccgcgcgcgaagccgtgcggggcatcacgctcccgcgcgagcgcaccggcgtgctcgtcggcatgggctgcgatcccgagatcgcccgctacggcacgcgctggcgcctcgcggattgggcggacacctgggcctctcgcgaaggcaaggtcgtctccgacgattggctctcccgcgcccgcgatgccgtgcagaccaagctccaggccgcgggcgtcgtggggacgatgcccaacatccccgcgaaccgcatcaacagccagctcgatctcgccggcctcggctacaccgtctccgccgagcaggcctcgggcattgtcgccttggagatcgccgcgcgcgcgctgcgtgaaggcgagctcgacgccgccgtcgtgggcgccgtcgatctctcggacgagcccgtgcaccgcgccgcgctcggccccgacgcgaagcccggcgatgccgccgtcgtgctcgtcctcaagcgtctcgacgacgcgcgtcgcgacggcgatcgcgtcctcgccctcctcgacggcgacggccccgccacgctccgcatcggcgacggcggcatcgatccttccgcgcatgcgaccgcgcacgccgccgccggcctcgttcacgtcgccaccgccatctggagcgtctttcacggcgcgcgccccgccgatggacgcgccgccacaccgtggctcggcacccgcagcgccgagaccgtgacacgctcgctcgccggcgcgcccaccaccgtgcgcatcgcgtccgccgcgccgccggccccgctcgccttcgagcctccgccgcgcctccacgtgatcgccggcgccgatcgcgccgccgtgatccgcgcgctctccggtggccccatctccaccgaaggcccggcccgcctcgtcatcgtcgccgcgaccgacgaagagcgcacgacccgtctcgcacaggccaaacgctacctcgaaaaaggcggccccgcgcccgagggcatcgcctaccgcgacgcgcccctcgccggcgatctcgccttc

SEQ ID NO: 160 - protein, 858 aa, Aetherobacter
  SOURCE 1..858: /mol_type="protein" /note="This sequence is generated from feature [CDS]: 1..2574 placed under sequence number 159" /organism="Aetherobacter"
VRFEPIAIVGEGCVLPGAASPSALREAVLAGRNAVTGVPDGRWRLPAAHSMGTPDHAVDRAWSDAGGYVEGFEPSFDPTGFHLSADRVRALDSSFRWVLHAARQALAFAGASRASARAGLVLGNLSFPTATMTRFAESVWLDAQGEAFLGGRARALAGVDRPDPQNRFMSGFPVQLAAEALGLGAGGFALDAACASSLYAIKLACDRLHDRSADLMLAGAVNAADNLFLHVGFCALAAMSRTGQSRPFHRDADGLVPAEGAAVVALKRLADARDAGDRILGVIRGVGLSNDGRGRGLLAPAEEGQIRAMRAAYAMSGLTPAHVSLVECHATGTPVGDATEVRSMTALFEGLRDVPIGSLKSNLGHLITVAGVAGLMKVLGAFAAGLRPPTLHADAPIDALRGSPFRLLTSAEEWPANGPRVAAVSAFGFGGNNAHLLVTEDDAGASVTSFVPASPAPPIAVVGIGAMLGDTTGADAAARAVLSGERWNPRRTDVTVALEGLRVPPRDLEQTLPQQLLALEAAREAVRGITLPRERTGVLVGMGCDPEIARYGTRWRLADWADTWASREGKVVSDDWLSRARDAVQTKLQAAGVVGTMPNIPANRINSQLDLAGLGYTVSAEQASGIVALEIAARALREGELDAAVVGAVDLSDEPVHRAALGPDAKPGDAAVVLVLKRLDDARRDGDRVLALLDGDGPATLRIGDGGIDPSAHATAHAAAGLVHVATAIWSVFHGARPADGRAATPWLGTRSAETVTRSLAGAPTTVRIASAAPPAPLAFEPPPRLHVIAGADRAAVIRALSGGPISTEGPARLVIVAATDEERTTRLAQAKRYLEKGGPAPEGIAYRDAPLAGDLAF

SEQ ID NO: 161 - protein, 858 aa, Aetherobacter; identical to SEQ ID NO: 160
  DOMAIN 1..858: "domain IIIa"
  SOURCE 1..858: /mol_type="protein" /organism="Aetherobacter"

SEQ ID NO: 162 - DNA, 3222 bp, Aetherobacter
  source 1..3222: /mol_type="DNA" /organism="Aetherobacter"
  CDS 1..3222: /codon_start=1 /gene="domain IIIb" /transl_table=11
aggagcggtgtccgccagctcgccaatgccgcagctgccttggtcgccgcgggcgtccccgtcgacaccgacgcgctccattccgcgctcggcgaaggcgcgcgcatcgataagcccaccggcgccaccatgcgaatccccgcccatccgccggccattcaactccctccattcgagtcttccgtgcaagtgatggtgcccgcgcctccgctcccgcccgtgttggagcaaccgctctccgccgcgatcccggtgcctcgtcccgagagccccaaagcctcctcgccgacaccgcatctcgcgacacccaccgtgaccgccccgccgccggtgcccctcgcggccgcgcctctgcctgccgcgacaacccttctcccggccccggcggcacccgagctcacggtcacgccatctcccacggtggagatcctggcccgcgccacacaacaacacgccctcctcggcgccattcatcgcgacttcctggaagcccaggccgcggcgcacacccagttcctcgcgctccagcaaaccatgctggccggcttgatgagggcctattcgagcgccccgccgagccccgccgtcgagctcctcgagcacccggtcaccgtctctcaggtcctcccggatcctgtgcaaattcaacagcctgcaccggactcggcacctcccgcgaccccgctccgcgcggcgccgcccccgagcgctctgcctcgtccggcagccgtctcgccgcctccgagcattctgcctctcccggccgccgccgcgccgccggtgtccctctcgcgccccgccccggtcgcgaaagccacgctccccggccccaagtacgatagggctcagctcgaggtcctcgcctccggcaacatctcttccgtcttcggcccagccttcgccgatcaggatggcttccaccgccaagtccgcatgcccatgccgccgctccttttggcggatcgggtgacgggcatcgccggtgagcatcacgcggtggggactggcaccatctggacggagacggacgtcaccaccgagagttggtatctccacgagggccgcatgcccgcggggatcatgatcgagtcgggtcaagccgatctcctcctcatctcctggcagggcgccgaccgccagaatcgcagcgagcgtgtctatcgcctcctcggctgcgacctcacgtatcacggcgagctgcccaagccgggcgacacgctcgtttacgacatccacatcgatggccacgcccgccagggcgacattcgtctcttcttcttccactacgattgtcgcatcaatggtgagctgcgcctctcggtgcgcagcggccaggccggcttcttcaccgaggccgagctcgccgactccggcggcatcctctgggacgcgcagacgggtgagcaccgcaccacgggcccgctcgatcctcccgccgtcgcttgcgccaaacgcagcttcacggagaccgaagtccgcgccttcgccgacggacgcgtggtcgattgtttcggccccggcttcgaaaagaccctcgcccacgtgcgcacgccgcgcatccagtccgagcgcatgctcttcctccgcgaggtcgtcgagttcgatccgcgcggcgggccttggggacgcggatacctgcgcgccgaagcgcccatcacgcccgatgattggtatttcacggggcacttcctcaacgacccttgcatgcctggaactctgatgttcgagggctgcgtgcaggccatgtcgttctacctcgtggccatgggcttctccgtcgatcgcgacggctggcgcttcgagcccgtcgccggccacaagatccccatgcgctgccgcgggcaggtcatcccgagctcgaagcgcctcacctacgaagtcttcgtcgaagaggtgattgcggggccagtgcccaccgtctatgccgatctcctctgcaccgtggatggcctcaaggcctttcacgcgcggcgtgtcggcctcaagctcgtccccgattggccgctcgccgattgggctcatcttcccgtcgcctccgccgcggatccggcccatcgcaccatggatcagcggaagctcggcggtctcgccggctgggtggagccgaagccggtggcctcgcacgagggcttcccgttcgattatccctcgctcctcgcctgcgcctgggggcgcccgtcggcggcgttcgggcccatgtatgcgcccttcgacggcccgcgcaacgtggcccgtttgcccgggccgccctatcacttcatgtcacgcatcacccgcacggacgcgcccatgggcgccttccgcgcgggcgcatcgatcgaggccgaatacgatgtcccgaaggaggcgtggtatttcgatctcaacgggcaccccaccatgcccttctgcgtgctcatggaggccgcgctccagccttgtggttggctcgcgagctacatcgggagcacgctcaccgccgacatcgatctcatgttccgcaacctcgatggaacggggacgttgctcgcggaggtcctgcccacctcgggcaccctgcgcacgcgcgccaaggtgacggacgtctcccgctcggcggggatgatcatcgagtcgttcgaggtcgagtgcttcgtcggcgacacctgcgtttacaagatgaagaccgtcttcgggttcttccccaaagaggccttcgaaaaccaggtgggtttgcccgtcaccccggaggagcgcgcccgcctcgaggctccctcctcgtatctcgtcgatctgcggagccgcccgtcacgctacttcgaggcctcgccccgcctgcccgagcccatgctctgcatgctcgatcgcgtcaccgcgtgggtgcccgagggcggcaaaaaggggctcggttgggcccgcggcgagaaggacgtcgatgcgagcgagtggttcttcaaagcccacttcttccaagatcccgtgcaacccgggtcgctcggcatcgaggcgctcgtccagctcctgcaattcgccatgatggagcggggcatggccgagggcgtgcccggcgcgcgcttcgagccggtcgcggtgggcaagccttccgtctggaaataccgcggtcaggtggtgccctcgaatcgccgcatcaccaccgagatcgacatcctcgaagtcggtgaggacgagcgcggtcgcttcgcggtggcggaaggctcgttgtgggtcgacggcaaacgcatctaccacaccaagtctctcgcc

SEQ ID NO: 163 - protein, 1074 aa, Aetherobacter
  SOURCE 1..1074: /mol_type="protein" /note="This sequence is generated from feature [CDS]: 1..3222 placed under sequence number 162" /organism="Aetherobacter"
RSGVRQLANAAAALVAAGVPVDTDALHSALGEGARIDKPTGATMRIPAHPPAIQLPPFESSVQVMVPAPPLPPVLEQPLSAAIPVPRPESPKASSPTPHLATPTVTAPPPVPLAAAPLPAATTLLPAPAAPELTVTPSPTVEILARATQQHALLGAIHRDFLEAQAAAHTQFLALQQTMLAGLMRAYSSAPPSPAVELLEHPVTVSQVLPDPVQIQQPAPDSAPPATPLRAAPPPSALPRPAAVSPPPSILPLPAAAAPPVSLSRPAPVAKATLPGPKYDRAQLEVLASGNISSVFGPAFADQDGFHRQVRMPMPPLLLADRVTGIAGEHHAVGTGTIWTETDVTTESWYLHEGRMPAGIMIESGQADLLLISWQGADRQNRSERVYRLLGCDLTYHGELPKPGDTLVYDIHIDGHARQGDIRLFFFHYDCRINGELRLSVRSGQAGFFTEAELADSGGILWDAQTGEHRTTGPLDPPAVACAKRSFTETEVRAFADGRVVDCFGPGFEKTLAHVRTPRIQSERMLFLREVVEFDPRGGPWGRGYLRAEAPITPDDWYFTGHFLNDPCMPGTLMFEGCVQAMSFYLVAMGFSVDRDGWRFEPVAGHKIPMRCRGQVIPSSKRLTYEVFVEEVIAGPVPTVYADLLCTVDGLKAFHARRVGLKLVPDWPLADWAHLPVASAADPAHRTMDQRKLGGLAGWVEPKPVASHEGFPFDYPSLLACAWGRPSAAFGPMYAPFDGPRNVARLPGPPYHFMSRITRTDAPMGAFRAGASIEAEYDVPKEAWYFDLNGHPTMPFCVLMEAALQPCGWLASYIGSTLTADIDLMFRNLDGTGTLLAEVLPTSGTLRTRAKVTDVSRSAGMIIESFEVECFVGDTCVYKMKTVFGFFPKEAFENQVGLPVTPEERARLEAPSSYLVDLRSRPSRYFEASPRLPEPMLCMLDRVTAWVPEGGKKGLGWARGEKDVDASEWFFKAHFFQDPVQPGSLGIEALVQLLQFAMMERGMAEGVPGARFEPVAVGKPSVWKYRGQVVPSNRRITTEIDILEVGEDERGRFAVAEGSLWVDGKRIYHTKSLA

SEQ ID NO: 164 - protein, 1074 aa, Aetherobacter; identical to SEQ ID NO: 163
  DOMAIN 1..1074: "domain IIIb"
  SOURCE 1..1074: /mol_type="protein" /organism="Aetherobacter"

SEQ ID NO: 165 - DNA, 912 bp, Aetherobacter
  source 1..912: /mol_type="DNA" /organism="Aetherobacter"
  CDS 1..912: /codon_start=1 /gene="domain IV" /transl_table=11
gtcttcaccggcgccgccgcttcctacgttggcatgggccgcgagctcgcgctcgcattgccctccgccgtcacgcgcctcggcgcgcgcttcgcgaccctcgcggacgcgacccgttggatcttcggcccgcccgccgcgcccaatcacccgctcgagcagctctgggcgagcgccttcctctgccagctccacgtggagatctcgcgcggcatcctgggcctcacgccgcaggcgaccattggttattcgtccggcgagagcaatgctctcttcgcttcgggcgcctggcgcgatctcgacgccatggtcgccgaatcgtggaagagccccattttcaccgacggcatcgtcggcgacttcaccgccgcgcgtcgcgcctggcgcaagctcggcagcgacggcacgtgggaggcatggagtgtcgccgcccccgtcgaagccgtccgcgaagcgctccgcggcgagcccacggcgcacctgaccatcatcaacacccccgaggactgcgtgatcggcggcgaggcctccgccgtcggccgtgtcctcgacaagctcggtcgctcccgcgcgctcccgctcgactacgaaatggccgcgcattgcccggagatcgaagagatccgaaaggagtggtacgacctccatcaccgcgccacgtcggacgttcccgacatccgcgtctactccgccggcagcgcgaccgccttccaagccacctcggatcgcgcggcggcggccatcactgcgcaggccgtgggcacgctcgatttcccccgcatgatcgagcgcgcctatgccgacggcgtccgcatcttcgtggagcacggcccgcgcggcctctgcagtggttgggtcaaacgcatcctcggtgaccgcgagcacctcgccgtttcactcgacgtcgccggc

SEQ ID NO: 166 - protein, 304 aa, Aetherobacter
  SOURCE 1..304: /mol_type="protein" /note="This sequence is generated from feature [CDS]: 1..912 placed under sequence number 165" /organism="Aetherobacter"
VFTGAAASYVGMGRELALALPSAVTRLGARFATLADATRWIFGPPAAPNHPLEQLWASAFLCQLHVEISRGILGLTPQATIGYSSGESNALFASGAWRDLDAMVAESWKSPIFTDGIVGDFTAARRAWRKLGSDGTWEAWSVAAPVEAVREALRGEPTAHLTIINTPEDCVIGGEASAVGRVLDKLGRSRALPLDYEMAAHCPEIEEIRKEWYDLHHRATSDVPDIRVYSAGSATAFQATSDRAAAAITAQAVGTLDFPRMIERAYADGVRIFVEHGPRGLCSGWVKRILGDREHLAVSLDVAG

SEQ ID NO: 167 - protein, 304 aa, Aetherobacter; identical to SEQ ID NO: 166
  DOMAIN 1..304: "domain IV"
  SOURCE 1..304: /mol_type="protein" /organism="Aetherobacter"

SEQ ID NO: 168 - DNA, 2160 bp, Aetherobacter
  source 1..2160: /mol_type="DNA" /organism="Aetherobacter"
  CDS 1..2160: /codon_start=1 /gene="domain IV*" /transl_table=11
atgcgcatcgtccccggcggcgcgcccccgcgcgggcctcgtgtcgggcaaccgcgtgaggaaacgctcgatgccgcggtcgacacgtggctcggcgatcatcggcccacgtggacgctgcccgcgctgccgatgatgtcgatggtcgatcgcctcgccgcggccgcgcagccttcgccgagcgggcgcgtcgtggagatcgccgacgtgcaagtgaagcgctggctcccgttcccgggcggccccgtgcgtctcaccacggaggtgaatcatcgcgacgacggagagcacgtcaccctgctcgccttccgcgaagcgcgtgacgccgcgctctcgcgcttcgagcccgtggccacgggccgcgtgcgtctcgcgccgcgtttcccggcgccgcccgcgcccttcgcgccgctcgcggacgccgcgcccatcgacgatccgtatgcctcgggcgcgctgttccacggcccctcgttccagatgctgcggtctctgcgcttcgggtccaaaggcgcttccgccatcctcgacatggccgagcgcggcgtcccccgcggggcgcttcatcaaggcctcctcgacgcgctcacccacgccattccccacgacgatctctcccggtggtcgcccgacatcgaaggcgatcaggtgggctatccctaccgcattccctcgattcgtttcttcggcgaaatgccttctgcgggagaaggccaattggaggtgcgcttcgccggcttcgacggacaaccgcgcttcccgaaattcgaggtccagctcctcgtcggcggcgtggtgcgcgtcgccctcacgctcgtcgaagtgctcctcccgcgcggccccatcggacagcggagccgcgcggatcgccgcgcgttcctgcgcgatcggcgcttcgtgccgggcgtgcgcctctcgcgcgccgagggcgccctcaccgtggctgcccccgaggacgtgaagccgagcgattggctccctggcaacgtcgcctgcatctatggagtcgccccgggcgccgatctcgtggccgaagtcgcggtgcgcgatcacctcgcccaacgtgccttcgtgcacccgagcaccgtgcgcccgagcgcggacctcgccgacgccacggtggccatgcggcctttgcgccggcatttcctcgacgtgcggcgcgacggcgacacggtgcgcgtctccgatgctcgcccgccggccatggacctcggcccggtggaagcgcattggcgcaagtggttcggcatcggcgcctggccggtggaggacctttattacggcctcatcgagcgcttcgtcggcgacgtggtgatcgccgatcccgaggccttcgccaaggtgcgcgggcggagctgcctttacctcgccaatcaccaggtcgcggtggagtcgctcctgttctcggtgctcgtctcggcgctctcgggcgtctccacgatcacgctggccaaggccgagcaccgggcctcgtgggtgggcgagctcatccggcagagcttcagttatcccggcatcaccgatcccggcctcatcacgttcttcgatcgcgaagatcgagagtccttgatgcgcatcatcggcgacctcgccgccgaaatggcccaacagggcaagagcgccatggtgcacgtcgaaggcacgcgctccctctcgtgccggcacccggtggtgaagatgagctccgcgttcatcgacatggcgctcgccgtgggcgcgcccatcgtgcccgtgcgtttcgtgggcggtttgccggccgaagagctctcgcaacgcatcgagttccccgtcggccacggtcgccaagacttctggctcggccgccccgtgctcccggaagagctgcgcgccctgccgctcaaagagcgcaagcaagtcgtgatcgacgccatcaatggcctcggtcccggcccgcagcacgaggagcctcatccgggggacaccgcgttcaccgcgcgcgtcgagtcctggaagccgcgcaccggcggcaacgcggagcgcgccacgctgctcgcgaccctggaggcgctgccggcccatcgctccgaagcgacggggaggctcgtcgagagcgcccgcgaagggcgttcgagctttggtgcggagccgagcgagcaatggctctctgggtttgcgcgctggctcttgggtggctga

SEQ ID NO: 169 - protein, 719 aa, Aetherobacter
  SOURCE 1..719: /mol_type="protein" /note="This sequence is generated from feature [CDS]: 1..2160 placed under sequence number 168" /organism="Aetherobacter"
MRIVPGGAPPRGPRVGQPREETLDAAVDTWLGDHRPTWTLPALPMMSMVDRLAAAAQPSPSGRVVEIADVQVKRWLPFPGGPVRLTTEVNHRDDGEHVTLLAFREARDAALSRFEPVATGRVRLAPRFPAPPAPFAPLADAAPIDDPYASGALFHGPSFQMLRSLRFGSKGASAILDMAERGVPRGALHQGLLDALTHAIPHDDLSRWSPDIEGDQVGYPYRIPSIRFFGEMPSAGEGQLEVRFAGFDGQPRFPKFEVQLLVGGVVRVALTLVEVLLPRGPIGQRSRADRRAFLRDRRFVPGVRLSRAEGALTVAAPEDVKPSDWLPGNVACIYGVAPGADLVAEVAVRDHLAQRAFVHPSTVRPSADLADATVAMRPLRRHFLDVRRDGDTVRVSDARPPAMDLGPVEAHWRKWFGIGAWPVEDLYYGLIERFVGDVVIADPEAFAKVRGRSCLYLANHQVAVESLLFSVLVSALSGVSTITLAKAEHRASWVGELIRQSFSYPGITDPGLITFFDREDRESLMRIIGDLAAEMAQQGKSAMVHVEGTRSLSCRHPVVKMSSAFIDMALAVGAPIVPVRFVGGLPAEELSQRIEFPVGHGRQDFWLGRPVLPEELRALPLKERKQVVIDAINGLGPGPQHEEPHPGDTAFTARVESWKPRTGGNAERATLLATLEALPAHRSEATGRLVESAREGRSSFGAEPSEQWLSGFARWLLGG

SEQ ID NO: 170 - protein, 719 aa, Aetherobacter; identical to SEQ ID NO: 169
  DOMAIN 1..719: "domain IV*"
  SOURCE 1..719: /mol_type="protein" /organism="Aetherobacter"

The invention claimed is:

1. Process for producing polyunsaturated fatty acids, comprising (a) transforming a host microorganism with a gene cluster encoding for the synthesis of polyunsaturated fatty acids; and (b) cultivating the host microorganism in the presence of a fermentable carbon source, said gene cluster comprises coding sequences for an enoyl reductase (ER) and an acyl transferase (AT), wherein the acyl transferase is an acyl glycerolphosphate acyl transferase (AGPAT) comprising an amino acid sequence at least 90% -identical to SEQ ID NO:95 or SEQ ID NO:129 encoded by domain IV* of the gene cluster from *Aetherobacter*.

2. The process according to claim 1, wherein the amino acid sequence of domain IV* is at least 95% identical to the amino acid sequence of SEQ ID NO:95 or SEQ ID NO:129.

3. The process according to claim 1, wherein the amino acid sequence encoded by domain IV* of *Aetherobacter* is of SEQ ID NO: 95 or SEQ ID NO: 129.

4. The process according to claim 1, wherein the domain IV* is contained in a nucleic acid sequence encoding the Pfa3 gene product comprising the amino acid sequence of SEQ ID NO: 72.

5. The process according to claim 1, wherein the gene cluster comprises from 5' to 3': (i) a pfa1 gene of domain I -encoding an enoyl reductase comprising the amino acid sequence of SEQ ID NO: 75, (ii) a pfa2 gene containing from 5' to 3' IIa encoding a ketosynthase and a malonyl-CoA-transacylase comprising the amino acid sequence of SEQ ID NO: 78, a domain IIb encoding at least one acyl carrier protein comprising the amino acid sequence of SEQ ID NO: 81, and a domain IIc encoding a keto reductase and a dehydratase comprising the amino acid sequence of SEQ ID NO: 84, and (iii) a pfa3 gene containing from 5' to 3' a domain IIIa encoding a keto synthase and a chain length factor comprising the amino acid sequence of SEQ ID NO: 87, a domain IIIb encoding at least one dehydratase comprising the amino acid sequence of SEQ ID NO: 90,and the domain IV*.

6. The process according to claim 5, wherein the gene cluster contains a domain IV encoding an acyl transferase (AT) comprising the amino acid sequence of SEQ ID NO: 93, which domain IV is arranged between domain IIIa and domain IIIb.

7. The process according to claim 1, wherein the gene cluster comprises a pfa1 gene encoding the enoyl reductase comprising the amino acid sequence of SEQ ID NO: 68.

8. The process according to claim 1, wherein the gene cluster comprises a pfa2 gene encoding a keto synthase, a malonyl-CoA-transacylase, an acyl carrier protein, a keto reductase, and a dehydratase comprising the amino acid sequence of SEQ ID NO: 70.

9. The process according to claim 1, wherein the gene cluster comprises a pfa3 gene encoding a keto synthase, a chain length factor, a dehydratase, and the acyl glycerolphosphate acyl transferase (AGPAT) comprising the amino acid sequence of SEQ ID NO: 72.

10. The process according to claim 1, wherein the gene cluster encodes the amino acid sequence encoded by the DNA sequence of SEQ ID NO: 63.

11. The process according to claim 1, wherein the fermentable carbon source is free of fatty acids.

12. The process according to claim 1, wherein the polyunsaturated fatty acid comprises at least 3 double bonds.

13. The process according to claim 1, wherein the production organism is selected from the group consisting of gram-negative eubacteria, gram-positive eubacteria, myxobacteria, fungi and yeasts.

14. The process according to claim 1, wherein one polyunsaturated fatty acid is present to at least 40 wt.-% based on the total weight of all polyunsaturated fatty acids contained in the composition.

15. The process according to claim 1, wherein the polyunsaturated fatty acid produced is any one or more of eicosapentanoic acid (EPA), docosa hexanoic acid (DHA), γ-linolenic acid, and linolenic acid.

* * * * *